US011136559B2

(12) United States Patent
Maeda et al.

(10) Patent No.: US 11,136,559 B2
(45) Date of Patent: Oct. 5, 2021

(54) ENGINEERED PREPHENATE DEHYDROGENASES AND AROGENATE DEHYDROGENASES AND METHODS OF USING THE SAME

(71) Applicant: Wisconsin Alumni Research Foundation, Madison, WI (US)

(72) Inventors: Hiroshi A. Maeda, Madison, WI (US); Craig Albert Schenck, Madison, WI (US)

(73) Assignee: WISCONSIN ALUMNI RESEARCH FOUNDATION, Madison, WI (US)

( * ) Notice: Subject to any disclaimer, the term of this patent is extended or adjusted under 35 U.S.C. 154(b) by 0 days.

(21) Appl. No.: 15/882,636

(22) Filed: Jan. 29, 2018

(65) Prior Publication Data

US 2018/0216083 A1     Aug. 2, 2018

Related U.S. Application Data

(60) Provisional application No. 62/451,124, filed on Jan. 27, 2017.

(51) Int. Cl.
*C12N 15/82* (2006.01)
*C12N 9/02* (2006.01)

(52) U.S. Cl.
CPC ......... *C12N 9/001* (2013.01); *C12N 15/8251* (2013.01); *C12Y 103/01012* (2013.01)

(58) Field of Classification Search
None
See application file for complete search history.

(56) References Cited

U.S. PATENT DOCUMENTS

| 7,396,664 | B2 | 7/2008 | Daly et al. |
| 9,701,977 | B2 | 7/2017 | Maeda et al. |
| 2015/0150157 | A1* | 5/2015 | Maeda ............... C12N 15/8251 800/278 |
| 2018/0265880 | A1 | 9/2018 | Maeda et al. |

FOREIGN PATENT DOCUMENTS

WO   WO 2002/090523   11/2002

OTHER PUBLICATIONS

Medicago truncatula arogenate dehydrogenase with a GenBank accession No. G7K796, published Jan. 25, 2012.*
Arachis hypogaea chloroplastic arogenate dehydrogenase 1, GenBank accession No. XP_025622852, published May 24, 2019.*
Arachis ipaensis chloroplastic arogenate dehydrogenase 1, GenBank accession No. XP_016180356, published Apr. 22, 2016.*
Schenck et al., 2015, Non-plastidic, tyrosine-insensitive prephenate dehydrogenases from legumes, Nature Chemical Biology 11: 52-57, published Nov. 17, 2014.*
Keskin et al., 2004, A new, structurally nonredundant, diverse data set of protein-protein interfaces and its implications Protein Science 13: 1043-1055.*
Guo et al., 2004, Protein tolerance to random amino acid change, Proceedings of the National Academy of Sciences USA 101: 9205-9210.*
Thornton et al., 2000, From structure to function: Approaches and limitations, Nature Structural Biology, structural genomic supplement, Nov. 2000: 991-994.*
Medicago truncatula prephenate/arogenate dehydrogenase, GenBank accession No. AES71257, published on Jun. 18, 2014.*
Medicago truncatula prephenate/arogenate dehydrogenase, UniProt accession No. G7J2E9, published on Jan. 25, 2012.*
Bonner et al., 2008, Cohesion Group Approach for Evolutionary Analysis of TyrA, a Protein Family with Wide-Ranging Substrate Specificities, Microbiology and Molecular Biology Reviews 72: 13-53.*
Ochrobactrum intermedium LMG 3301 prephenate/arogenate dehydrogenase, UniProt accession No. C4WNJ2, published Jul. 28, 2009.*
Adams, P. D. et al. PHENIX : a comprehensive Python-based system for macromolecular structure solution. Acta Crystallogr. D Biol. Crystallogr. 66, 213-221 (2010).
Ambawat, S. et al., MYB transcription factor genes as regulators for plant responses: An overview. Physiol. Mol. Biol. Plants 19, 307-321 (2013).
Beaudoin, G. A. W. & Facchini, P. J. Benzylisoquinoline alkaloid biosynthesis in opium poppy. Planta 240, 19-32 (2014).
Bentley, R. (University of S. The Shikimate Pathway—A Metabolic Tree with Many Branches. Crit Rev. Biochem Mol Biol 25, 307-84 (1990).
Bonner, C. A. et al., Cohesion group approach for evolutionary analysis of TyrA, a protein family with wide-ranging substrate specificities. Microbiol. Mol. Biol. Rev. MMBR 72, 13-53 (2008).
Bonner, C. A. et al., Distinctive enzymes of aromatic amino acid biosynthesis that are highly conserved in land plants are also present in the chlorophyte alga *Chlorella sorokiniana*. Plant Cell Physiol. 36, 1013-1022 (1995).
Bonvin, J. et al., Biochemical characterization of prephenate dehydrogenase from the hyperthermophilic bacterium *Aquifex aeolicus*. Protein Sci. 15, 1417-32 (2006).
Brockington, S.F., et al., Phylogeny of the Caryophyllales sensu lato: Revisiting hypotheses on pollination biology and perianth differentiation in the core Caryophyllales. 2009 International Journal of Plant Sciences 170: 627-643.
Brockington, S.F., et al., Lineage-specific gene radiations underlie the evolution of novel betalain pigmentation in Caryophyllales. New Phytol. 207, 1170-1180 (2015).

(Continued)

*Primary Examiner* — Bratislav Stankovic
(74) *Attorney, Agent, or Firm* — Quarles & Brady LLP

(57) ABSTRACT

The invention generally relates to engineered prephenate dehydrogenases and arogenate dehydrogenases and methods of using the same. More specifically, the invention relates in part to compositions including engineered prephenate dehydrogenases (PDH) polypeptides and engineered arogenate dehydrogenase (ADH) polypeptides with altered substrate preferences and tyrosine sensitivities and methods of using the same.

11 Claims, 26 Drawing Sheets
(21 of 26 Drawing Sheet(s) Filed in Color)
Specification includes a Sequence Listing.

(56) References Cited

OTHER PUBLICATIONS

Brockington, S.F., et al., Complex pigment evolution in the Caryophyllales. New Phytol. 190, 854-864 (2011).

Cardoso, D. et al. Revisiting the phylogeny of papilionoid legumes: New insights from comprehensively sampled early-branching lineages. Am. J. Bot. 99, 1991-2013 (2012).

Chávez-Béjar, M. I. et al. Metabolic engineering of *Escherichia coli* for L-tyrosine production by expression of genes coding for the chorismate mutase domain of the native chorismate mutase-prephenate dehydratase and a cyclohexadienyl dehydrogenase from *Zymomonas mobilis*. Appl. Environ. Microbiol. 74, 3284-3290 (2008).

Christendat, D., et al., Use of site-directed mutagenesis to identify residues specific for each reaction catalyzed by chorismate mutase-prephenate dehydrogenase from *Escherichia coli*. Biochemistry (Mosc.) 37, 1573-1580 (1998).

Christendat, D. & Turnbull, J. L. Identifying groups involved in the binding of prephenate to prephenate dehydrogenase from *Escherichia coli*. Biochemistry (Mosc.) 38, 4782-4793 (1999).

Connelly , J. A. & Conn, E. E. Tyrosine biosynthesis in Sorghum bicolor: isolation and regulatory properties of arogenate dehydrogenase. Verlag der Zeitschrift fur Natwforsch. 41c,69-78 ( 1986).

Dal Cin, V. et al. Identification of Genes in the Phenylalanine Metabolic Pathway by Ectopic Expression of a MYB Transcription Factor in Tomato Fruit. Plant Cell 23, 2738-2753 (2011).

Delaux, P.M. et al., Comparative phylogenomics uncovers the impact of symbiotic associations on host genome evolution. 2014 PLoS Genetics 10: e1004487.

Des Marais, D. L. To betalains and back again: A tale of two pigments. New Phytol. 207, 939-941 (2015).

Dornfeld, C. et al. Phylobiochemical characterization of class-Ib aspartate/prephenate aminotransferases reveals evolution of the plant arogenate phenylalanine pathway. Plant Cell 26, 3101-3114 (2014).

Facchini, P. J. Alkaloid biosynthesis in plants: Biochemistry, cell biology, molecular regulation, and metabolic engineering applications. Annu. Rev. Plant Physiol. Plant Mol. Biol. 52, 29-66 (2001).

Fischer, R. S. & Jensen, R. A. Prephenate dehydrogenase (monofunctional). Methods Enzymol. 142, 503-507 (1987).

Gaines, C. G., et al., L-Tyrosine regulation and biosynthesis via arogenate dehydrogenase in suspension-cultured cells of Nicotiana silvestris Speg. et Comes. Planta 156,233-240 (1982).

Galanie, S. et al., Complete biosynthesis of opioids in yeast. DOI: 10.1126/science.aac9373, Published Online Aug. 13, 2015.

Gamborg, O.L. & Keeley, F. W. Aromatic metabolism in plants I.A study of the prephenate dehydrogenase from bean plants. Biochim. Biophys .Acta 115,65-72 ( 1966).

Greenberg, A.K. & Donoghue, M.J. Molecular systematics and character evolution in Caryophyllaceae. 2011 Taxon 60: 1637-1652.

Hagel, J. M. & Facchini, P. J. Benzylisoquinoline alkaloid metabolism: a century of discovery and a brave new world. Plant Cell Physiol. 54, 647-672 (2013).

Hatlestad, G. J. et al., The beet Y locus encodes an anthocyanin MYB-like protein that activates the betalain red pigment pathway. Nat. Genet. 47, 92-6 (2015).

Hernández-Ledesma, P., et al. A taxonomic backbone for the global synthesis of species diversity in the angiosperm order Caryophyllales. Willdenowia 45, 281-383 (2015).

Hudson, G.S. et al., Chorismate mutase/prephenate dehydrogenase from *Escherichia coli* K12: purification, characterization, and identification of a reactive cysteine. Biochemistry 23, 6240-6249 (1984).

Hunter, S. C. & Cahoon, E. B. Enhancing vitamin E in oilseeds: unraveling tocopherol and tocotrienol biosynthesis. Lipids 42, 97-108 (2007).

Jensen, R. A. & Pierson, D. L. Evolutionary implications of different types of microbial enzymology for L-tyrosine biosynthesis. Nature 254, 667-671 (1975).

Jung, E., et al., Chloroplasts of higher plants synthesize L-phenylalanine via L-arogenate. Proc. Natl. Acad. Sci. U. S. A. 83, 7231-7235 (1986).

Kristensen, C. et al., Metabolic engineering of dhurrin in transgenic *Arabidopsis* plants with marginal inadvertent effects on the metabolome and transcriptome. 2015 Proceedings of the National Academy of Sciences of the United States of America 102: 1779-1784.

Kutchan, T. M. Alkaloid biosynthesis: The basis for metabolic engineering of medicinal plants. Plant Cell 7, 1059-1070 (1995).

Legrand, P. et al., Biochemical Characterization and Crystal Structure of Synechocystis Arogenate Dehydrogenase Provide Insights into Catalytic Reaction. 2006 Structure 14: 767-776.

Leuchtenberger, W., et al., Biotechnological production of amino acids and derivatives: current status and prospects. Appl. Microbiol. Biotechnol. 69, 1-8 (2005).

Lopez-Nieves, S. et al. "Relaxation of tyrosine pathway regulation underlies the evolution of betalain pigmentation in caryophylales." (2017) New Phytologist.

Lütke-Eversloh, T. & Stephanopoulos, G. Feedback inhibition of chorismate mutase/prephenate dehydrogenase (TyrA) of *Escherichia coli*: generation and characterization of tyrosine-insensitive mutants. Appl. Environ. Microbiol. 71, 7224-7228 (2005).

Lütke-Eversloh, T. et al., Perspectives of biotechnological production of L-tyrosine and its applications. Appl. Microbiol. Biotechnol. 77, 751-762 (2007).

Maeda, H. et al. RNAi suppression of arogenate dehydratase1 reveals that phenylalanine is synthesized predominantly via the arogenate pathway in petunia petals. Plant Cell 22, 832-49 (2010).

Maeda, H. & Dudareva, N. The Shikimate Pathway and Aromatic Amino Acid Biosynthesis in Plants. Annu. Rev. Plant Biol 63, 73-105 (2012).

Maeda, H., et al. Prephenate aminotransferase directs plant phenylalanine biosynthesis via arogenate. Nat. Chem. Biol. 7, 19-22 (2011).

Millgate, A. G. et al. Analgesia: Morphine-pathway block in top1 poppies. Nature 431, 413-414 (2004).

Raman, S., et al., Evolution-guided optimization of biosynthetic pathways. Proc. Natl. Acad. Sci. U. S. A. 111, 17803-17808 (2014).

Reyes-Prieto, A. & Moustafa, A. Plastid-localized amino acid biosynthetic pathways of Plantae are predominantly composed of non-cyanobacterial enzymes. Sci. Rep. 2, 955 (2012).

Rippert, P., et al., Engineering plant shikimate pathway for production of tocotrienol and improving herbicide resistance. Plant Physiol. 134, 92-100 (2004).

Rippert, P. & Matringe, M. Molecular and biochemical characterization of an *Arabidopsis thaliana* arogenate dehydrogenase with two. Plant Mol. Biol. 48, 361-368 (2002).

Rippert, P. & Matringe, M. Purification and kinetic analysis of the two recombinant arogenate dehydrogenase isoforms of *Arabidopsis thaliana* 2002 European Journal of Biochemistry 269: 4753-4761.

Rippert, P., et al., Tyrosine and Phenylalanine are Synthesized within the Plastids in *Arabidopsis*. Plant Physiol. 149, 1251-1260 (2009).

Rubin, J. L. et al., "Enzymology of L-Tyrosine Biosynthesis in Mung Bean (*Vigna radiata* [L.] *Wilczek*)," 1979 Plant Physiol. 64:727-734.

Sariaslani, F. S. Development of a combined biological and chemical process for production of industrial aromatics from renewable resources. Annu. Rev. Microbiol. 61, 51-69 (2007).

Schenck, C.A., et al. Tyrosine biosynthesis, metabolism, and catabolism in plants. Phytochemistry. May 2018;149:82-102.

Schenck, C.A., et al. "Conserved molecular mechanism of TyrA dehydrogenase substrate specificity underlying alternative tyrosine biosynthetic pathways in plants and microbes." (2017) Frontiers in Molecular biosciences.

Schenck, C.A., et al., Molecular Basis of the evolution of alternative tyrosine biosynthetic routes in plants. 2017 Nature Chemical Biology 13: 1029-1035.

Schenck, C.A., et al. Non-plastidic, tyrosine-insensitive prephenate dehydrogenases from legumes, Nature Chemical Biology, 2015, pp. 52-57, vol. 11.

(56) References Cited

OTHER PUBLICATIONS

Siehl, D.L. "The Biosynthesis of Tryptophan, Tyrosine, and Phenylalanine from Chorismate," 1999 Plant Amino Acids: Biochemistry and Biotechnology, Edited by Bijay K. Singh, pp. 171-204.

Song, J., et al., The TyrA family of aromatic-pathway dehydrogenases in phylogenetic context. BMC Biol. 3, 13 (2005).

Sun, W., et al. The Crystal Structure of Aquifex aeolicus Prephenate Dehydrogenase Reveals the Mode of Tyrosine Inhibition. J. Biol. Chem. 284, 13223-13232 (2009).

Sun, W., et al. Crystal Structure of Prephenate Dehydrogenase from Aquifex aeolicus. Insights into the Catalytic Mechanism. 2006 Journal of Biological Chemistry 281: 12919-12928.

Tatiersall, D.B., et al., Resistance to an herbivore through engineered cyanogenic glucoside synthesis. 2001 Science 293: 1826-1828.

Vannelli, T., et al., Production of p-hydroxycinnamic acid from glucose in *Saccharomyces cerevisiae* and *Escherichia coli* by expression of heterologous genes from plants and fungi. Metab. Eng. 9, 142-151 (2007).

Wang, Y., et al., Metabolic engineering of flavonoids in plants and microorganisms. Appl. Microbiol. Biotechnol. 91, 949-956 (2011).

Wierenga, R. K., et al. Interaction of pyrophosphate moieties with alpha-helices in dinucleotide-binding proteins. Biochemistry (Mosc.) 24, 1346-1357 (1985).

Wojciechowski, M. F., et al., A phylogeny of legumes (Leguminosae) based on analysis of the plastid matK gene resolves many well-supported subclades within the family. Am. J. Bot. 91, 1846-62 (2004).

Yang, Y., et al. Dissecting molecular evolution in the highly diverse plant clade Caryophyllales using transcriptome sequencing. 2015 Molecular Biology and Evolution, 32, 2001-2014.

Office Action for U.S. Appl. No. 14/548,216, dated Mar. 28, 2016.
Office Action for U.S. Appl. No. 14/548,216, dated Nov. 25, 2016.

\* cited by examiner

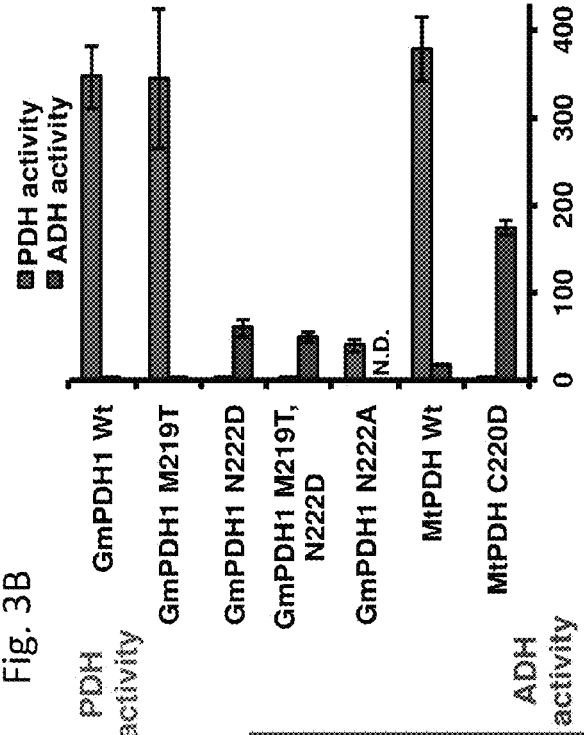
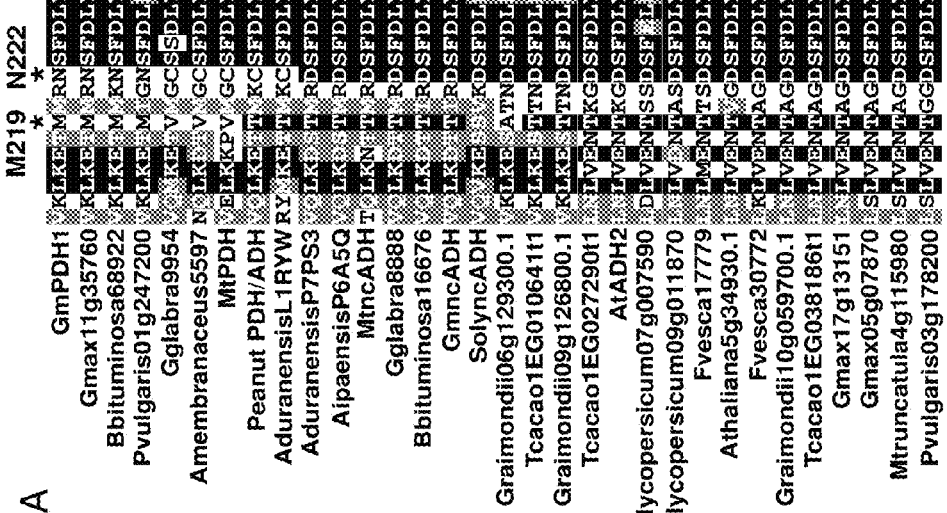
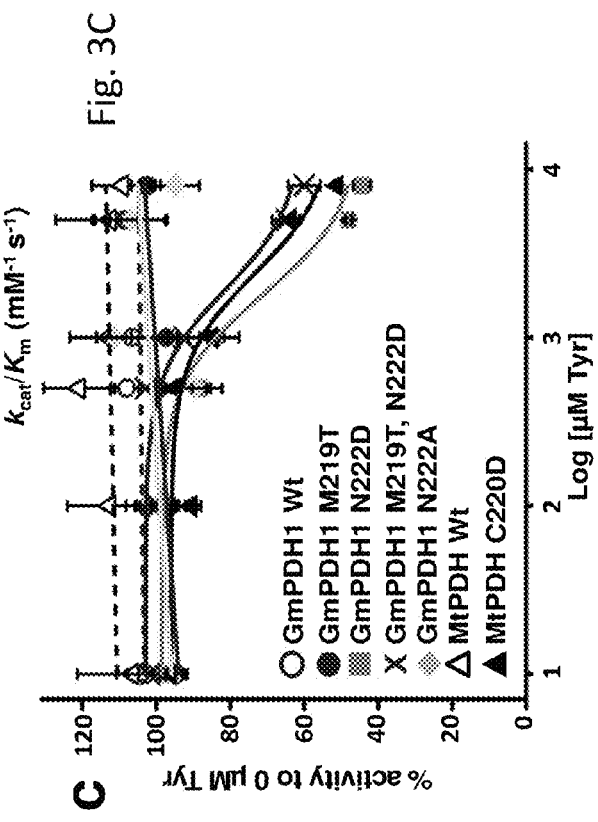
Fig. 3A
Fig. 3B
Fig. 3C

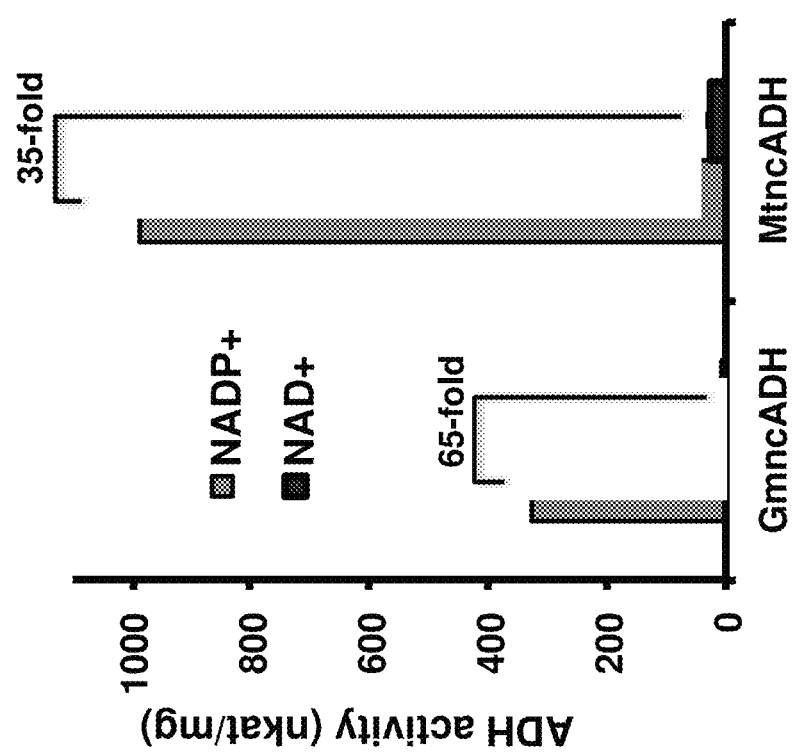

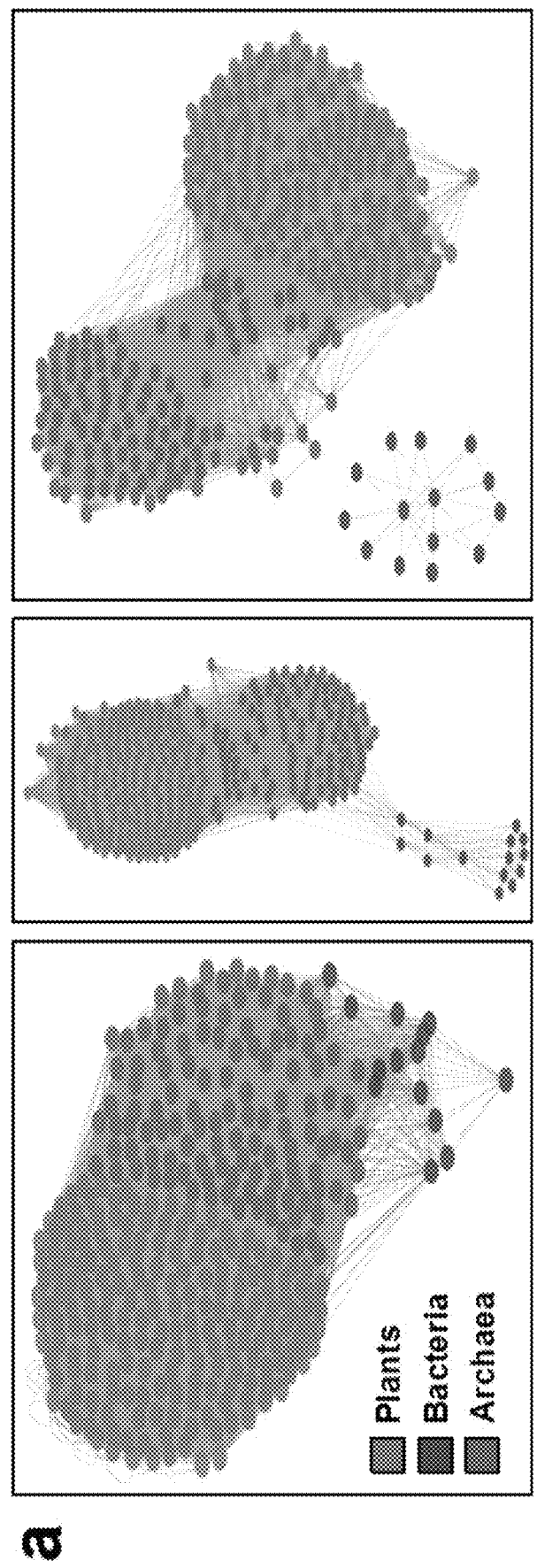

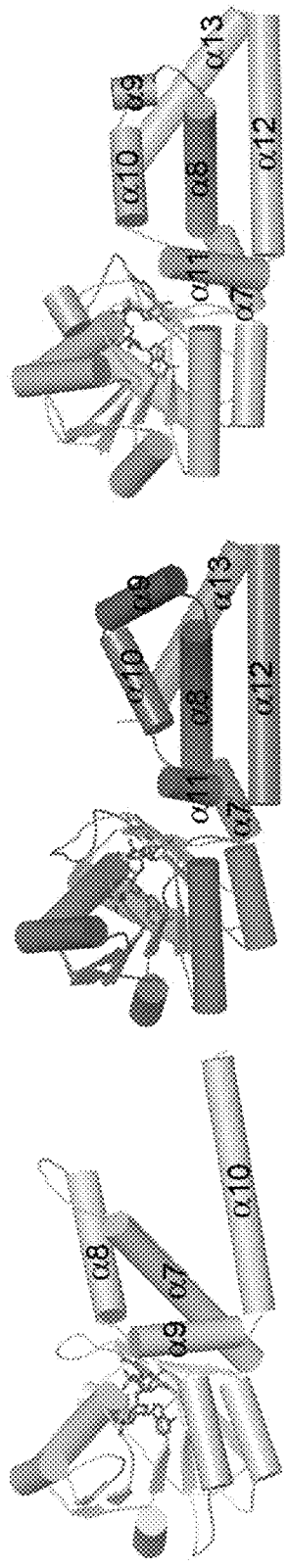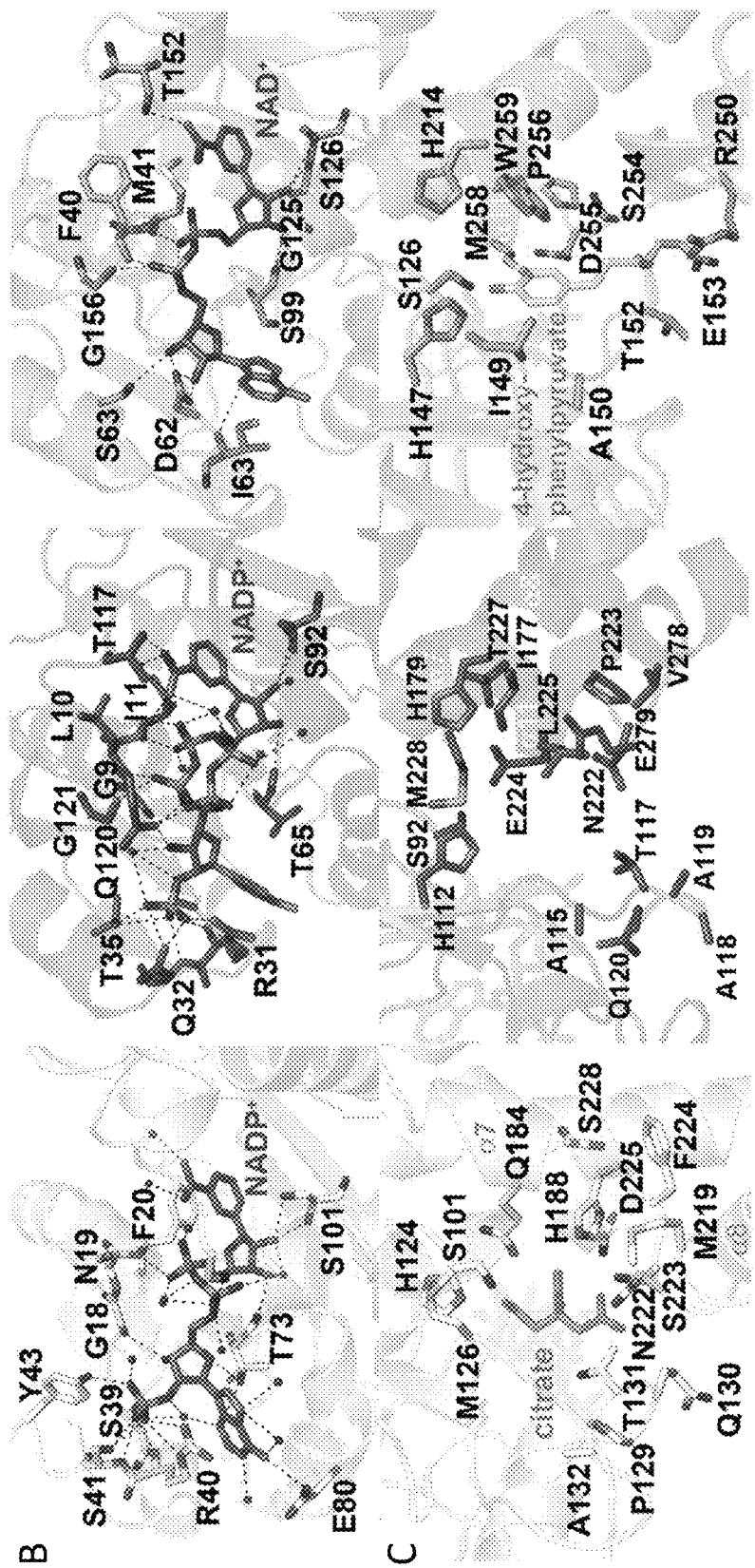
Fig. 11A
Fig. 11B
Fig. 11C

ENGINEERED PREPHENATE DEHYDROGENASES AND AROGENATE DEHYDROGENASES AND METHODS OF USING THE SAME

CROSS-REFERENCE TO RELATED PATENT APPLICATIONS

The present application claims the benefit of priority to U.S. Provisional Patent Application No. 62/451,124, filed on Jan. 27, 2017, the content of which is incorporated herein by reference in its entirety.

STATEMENT REGARDING FEDERALLY SPONSORED RESEARCH

This invention was made with United States government support awarded by the National Science Foundation grant number IOS-1354971. The United States has certain rights in this invention.

SEQUENCE LISTING

This application is being filed electronically via EFS-Web and includes an electronically submitted Sequence Listing in .txt format. The .txt file contains a sequence listing entitled "2018-01-29-_5671-00080_ST25.txt" created on Jan. 29, 2018 and is 668,439 bytes in size. The Sequence Listing contained in this .txt file is part of the specification and is hereby incorporated by reference herein in its entirety.

INTRODUCTION

L-Tyrosine (Tyr) is an essential aromatic amino acid required for protein synthesis in all organisms but, synthesized de novo only in plants and microorganisms. The Neurotransmitters such as catecholamines in metazoans are derived from Tyr, which must be obtained from their diet, as they cannot synthesize Tyr de novo[8]. In plants, Tyr serves as the precursor to numerous specialized metabolites crucial for both plant and human health, such as antioxidants vitamin E, the photosynthetic electron carrier plastoquinone, betalain pigments, and defense compounds, including dhurrin, rosmarinic acid, and isoquinoline alkaloids (e.g. morphine)[9-14]. The major plant cell wall component lignin can also be syntheized from Tyr in grasses[15].

Tyr is synthesized from prephenate, a shikimate pathway product, by two reactions, an oxidative decarboxylation and a transamination. The TyrA enzymes catalyze the oxidative decarboxylation step and are the key regulatory enzymes of Tyr biosynthesis, as they are usually inhibited by Tyr and compete for substrates that are also used in L-phenylalanine biosynthesis. In many microbes an NAD(H)-dependent prephenate dehydrogenase/TyrA (PDH/TyrA$_p$; EC 1.3.1.13) converts prephenate into 4-hydroxyphenylpyruvate (HPP) followed by transamination to Tyr by Tyr aminotransferase (TAT). In plants, these two reactions occur in the reverse order, with prephenate first being transaminated to arogenate by prephenate aminotransferase (PPA-AT), followed by oxidative decarboxylation to Tyr by an NADP(H)-dependent arogenate dehydrogenase/TyrA (ADH/TyrA$_a$; EC 1.3.1.78)[19-24]. Some exceptions to these "textbook" models are found in nature including microbes that use ADH to synthesize Tyr[25,26] and plants such as legumes having PDH activity[5,27,28]. Also, some microbial TyrAs prefer NADP(H) cofactor[18,9]. Thus, variations exist in the TyrA enzymes in diverse organisms, yet the molecular basis underlying TyrA substrate specificity and the alternative Tyr pathways is currently unknown.

Comparison of microbial TyrA sequences identified an aspartate residue downstream of the NAD(P)(H) binding motif that was later shown to confer cofactor specificity of TyrA[16,30]. Site-directed mutagenesis of *Escherichia coli* PDH and structural analysis of *Aquifex aeolicus* PDH identified an active site histidine, which interacts with substrate C4-hydroxyl and is critical for catalysis in each PDH. The same studies also showed that an active site arginine is necessary for substrate binding, but not for substrate specificity[31-34]. Besides their varied substrate and cofactor specificities, TyrA enzymes also exhibit different regulatory properties. Mutation of another active site histidine, which is present in the *E. coli* and *A. aeolicus* PDHs but absent in Tyr-insensitive *Synechocystis* ADH, relieved Tyr inhibition but simultaneously reduced PDH activity[34]. Random mutagenesis of the *E. coli* enzyme identified additional residues that relaxed Tyr inhibition; however, PDH activity was also reduced in these mutants[35]. Sequence and structural comparisons of divergent TyrA homologs, however, have been unable to identify specific determinants of Tyr-sensitivity and substrate specificity[16,29,30,33,34].

Understanding the specific determinants of Tyr-sensitivity and substrate specificity in ADH or PDH enzymes would allow one to engineer new ADH or PDH polypeptides with unique properties that would be useful in producing important commercial products derived from the Tyr pathway. For example, betalains, important pharmaceuticals such as L-dihydroxyphenylalanine (L-DOPA), and benzylisoquinoline alkaloids such as morphine are synthesized from Tyr. Betalains are used as a natural food dye (E162) and have anticancer and antidiabetic properties. Consequently, there is a need in the art for new ADH or PDH polypeptides that may be used to enhance the production of Tyr in cells, and thus the yield of Tyr-derived plant natural products important for human health and nutrition.

BRIEF DESCRIPTION OF DRAWINGS

The patent or application file contains at least one drawing executed in color. Copies of this patent or patent application publication with color drawing(s) will be provided by the Office upon request and payment of the necessary fee.

FIG. 1A shows two Tyr biosynthetic routes from prephenate. The PDH (blue, left) pathway is present in most microbes and legumes, whereas the ADH (red, right) pathway is ubiquitous in plants. Dashed line represents feedback inhibition by Tyr. FIG. 1B shows a phylogenetic analysis of TyrA homologs from various eudicot lineages identified a clade of ADH/PDH homologs (noncanonical, gray box) distinct from previously characterized plant ADH (canonical). Plant PDHs form a subgroup in the noncanonical clade. FIG. 1C is a graph showing PDH (blue; top) and ADH (red; bottom) activity of PDH, and noncanonical ADHs with NADP$^+$ cofactor from 4 plants. Catalytic efficiency ($k_{cat}/K_m$) is expressed as mM$^{-1}$ s$^{-1}$±SEM of n≥3. N.D., below detection limit. FIG. 1D is a graph showing the effect of Tyr on plant ADH and PDHs. Data are shown as IC$_{50}$ plots with enzymatic activity determined at increasing amounts of L-Tyr (0-8 mM). Activity was normalized to an assay with no L-Tyr and expressed as percent activity of n=3±SEM. PPA-AT, Prephenate aminotransferase, TAT, Tyrosine aminotransferase.

FIG. 2A is a ribbon diagram showing the monomeric units (colored gold (left) and white (right), respectively) of the homodimer. NADP+ (green) and citrate (purple) are depicted as space-filling models. The N- and C-terminal domains are also indicated. FIG. 2B is an electron density map for NADP+. The $2F_o-F_c$ omit map (1.5 σ) for the ligand is shown. FIG. 2C shows the nicotinamide cofactor binding pocket of GmPDH1. Residues surrounding the bound NADP+ (green) and water molecules (red spheres) are shown. Ligand interactions are indicated by dotted lines. FIG. 2D shows the active site residues in GmPDH1 in contact with citrate (purple) to identify the proposed prephenate binding site.

FIGS. 3A-3C show the identification of Asn222 as a determinant of PDH activity and Tyr sensitivity. FIG. 3A shows a trimmed amino acid alignment corresponding to the phylogeny in FIG. 1B highlighting residues Met219 and Asn222 (number based on GmPDH1; See SEQ ID NOs: 169-200). FIG. 3B is a graph showing PDH (blue; top bar) and ADH (red; bottom bar) activity of GmPDH1, MtPDH and corresponding site-directed mutants. Bars represent average catalytic efficiency ($k_{cat}/K_m$) in $mM^{-1}$ $s^{-1}$±SEM of n=3 replications. N.D., below detection limit. FIG. 3C is a graph showing the effect of Tyr on PDH activity of wild-type and mutant GmPDH1 and MtPDH. Data are shown as $IC_{50}$ plots with enzymatic activity determined at increasing concentrations of L-Tyr (0-8 mM). Activity was normalized to an assay with no L-Tyr and expressed as percent activity of n=3±SEM. Open symbols correspond to wild-type enzymes, with dashed lines. Mutant enzymes have filled symbols with solid lines.

FIG. 4A is a set of ribbon diagrams showing the overlay of GmPDH1 (blue), GmPDH1 N222D (rose), and GmPDH1 M219T/N222D (white) with NADP+ (green) shown as a space-filling model. FIG. 4B is an active site overlay of wild-type and mutant GmPDH1 which shows a conserved architecture. Coloring of side-chains is the same as for panel A. FIG. 4C shows active site residues in GmPDH1 M219T/N222D in contact with Tyr (purple). FIG. 4D shows molecular docking of arogenate (rose) into the active site of GmPDH1 M219T/N222D. The surface of the active site pocket is shown with the surface corresponding to Asp222 colored red.

FIG. 5A is a graph showing ADH activity from wild-type ADH enzymes and their mutants that remove Asp at the corresponding 222 position. Bars represent average catalytic efficiency ($k_{cat}/K_m$) in $mM^{-1}$ $s^{-1}$±SEM for n=3. Activity from AtADH2 is shown as specific activity (nkat/mg±SEM for n=3) as kinetics were unable to be determined. N.D., below detection limit. FIG. 5B shows $IC_{50}$ plots analyzing Tyr sensitivity of ADH activity from wild-type and mutated ADHs. Enzymes were tested for ADH activity at increasing concentrations of Tyr (0-8 mM) and were normalized to the 0 mM assay. Bars are average activity±SEM for n=3. Open symbols correspond to wild-type enzymes, with dashed curves. Mutant enzymes have filled symbols with solid curves.

FIG. 6 shows cofactor specificity of legume noncanonical ADH enzymes. ADH activity was measured for purified recombinant ncADHs from soybean (GmncADH) and *M. truncatula* (MtncADH) using either NADP+ (gray) or NAD+ (black). Bars are average specific activity (nkat/mg)±SEM (n=3). The ratio of ADH activity with NADP+ to NAD+ is shown above the bars.

FIG. 7A is a bar graph showing PDH (blue; top bar) and ADH (red; bottom bar) activity of purified recombinant *A. ipaensis* (peanut PDH/ADH) and tomato (SolyncADH) enzymes with NADP+. Bars represent average catalytic efficiency ($k_{cat}/K_m$) expressed as $mM^{-1}$±SEM of n≥3. N.D., below detection limit. FIG. 7B is a graph showing the effect of Tyr on ADH (red) and PDH (blue) activity. Data are shown as $IC_{50}$ plots with enzymatic activity determined at increasing concentrations of L-Tyr (0-8 mM). Activity was normalized to an assay with no L-Tyr and expressed as percent activity of n=3±SEM. Only effects of Tyr on ADH activity from SolyncADH are shown, as it had no activity with prephenate.

FIG. 9A shows a neighbor-joining phylogenetic analysis created in MEGA6[45] similar to FIG. 1B except with ADH and PDH homologs mainly from legumes. The tree was constructed with 1000 bootstrap values and evolutionary distances were computed using the Poisson correction method involving 90 amino acid sequences. All positions with less than 70% site coverage were eliminated. The noncanonical TyrA clade is shaded gray, stars represent enzymes that were biochemically characterized in this study. FIG. 9B shows the TyrA homolog distribution within the Leguminosae. Presence of TyrA homologs for legumes with sequencing data available were mapped onto a representative Leguminosae taxonomic tree[41,42] with major subclades indicated by black circles. Presence of TyrA homolog is indicated by a filled box (red, canonical or noncanonical ADH, blue PDH) absence is indicated by an empty box. Although limited legume sequences are available, our results suggest that PDHs duplicated within Leguminosae at least as early as the divergence of Genistoids (*Lupinus* containing) from Dalbergioids (peanut containing).

FIGS. 10A-10C show Asp222 is conserved in plant ADHs and bacterial orthologs. A sequence similarity network[58] was created using GmPDH1 to identify 318 homologs (BLAST® alignment tool e-value≤$10^{-5}$) and visualized in Cytoscape[59]. Each circle (node) represents a single TyrA homolog with each line (edge) connecting the nodes representing two proteins that have sequence similarity greater than a given threshold. FIG. 10A is a pictorial in which 100% networks are shown with increasing sequence similarity scores from left to right of ≥20, 25, and 30, respectively. In FIG. 10B the 100% network shows that plant TyrAs (green) are separate, but more closely related to bacterial (red) than archaeal (blue) enzymes. The corresponding residue at position 222 is shown for selected TyrA homologs on top of the node that it represents. *Phenylobacterium zucineum* (α-proteobacteria ortholog) is from the same genus as *Phenylobacterium immoble* that contains ADH activity[26]. Algal orthologs fall into the plant group including *Cyanidioschyzon merolae* (red algae), *Aureococcus anophagefferens* (brown algae) and *Craspedia variabilis* (green algae), which is from the same genus that contains ADH activity[60]. FIG. 10C shows a trimmed sequence alignment of the TyrA homologs that are marked in panel B showing the corresponding 222 residue (SEQ ID NOs: 201-247).

FIGS. 11A-11C show a structural comparison of plant PDH, cyanobacterial ADH, and bacterial PDH. FIG. 11A shows ribbon diagrams shown as cylinders of GmPDH1 (white, left), SynADH (purple, center), and AaPDH (gold, right) with $NAD^+/NADP^+$ (green) shown as a stick model. FIG. 11B shows the $NAD^+/NADP^+$ binding sites of GmPDH1, SynADH, and AaPDH show variation in the cis- vs. trans-conformations. The SynADH structure from the PDB depicts the diphosphate moiety in two cis-conformations. Coloring of the ribbons and side-chains is the same as for panel A. FIG. 11C shows the active site residues in GmPDH1 in contact with Tyr (purple), apo SynADH, and AaPDH with 4-hydroxyphenylpyruvate bound (gray).

FIG. 13A is a bar graph showing purified recombinant SsTyrA (spirocheates) used to test enzymatic activity, and shown as the average in nKat/mg protein±SEM of n=3. FIG. 13B is a bar graph showing α-proteobacteria TyrA (OiTyrA) cell lysate used as purification of the recombinant enzyme was not successful. Average enzymatic activity is shown as pKat/mg protein±SEM of n=3. FIG. 13C is a bar graph showing purified recombinant MhTyrA (archaea) used to test enzymatic activity, and shown as the average in nKat/mg protein±SEM of n=3. N.D. no activity detected. Cofactor preference is indicated by the fold-change over the bars.

FIG. 19A is an overlay showing both BdTyrA models and their template structures. The overall conformation is generally conserved across divergent TyrAs, with some exceptions highlighted with arrows. An extended loop region is present in both models of BdTyrA and *Synechocystis* ADH, and there are additional α-helices in BdTyrA (*Synechocystis*) and *Synechocystis* ADH. FIG. 19B shows that all enzymes possess the catalytic His and Ser residues, although His112 in *Synechocystis* ADH is in a slightly different position within the active site. The substrate specificity determining residue is present in only GmPDH1 (Asn222), whereas Asp227 in BdTyrA (GmPDH1) is shown but did not align with Asn222 in PROMALS3D alignments and adopts a different conformation and position than Asn222. In BdTyrA (*Synechocystis* ADH) and *Synechocystis* ADH a corresponding residue is lacking entirely in the active site.

SUMMARY

Figure 1A:
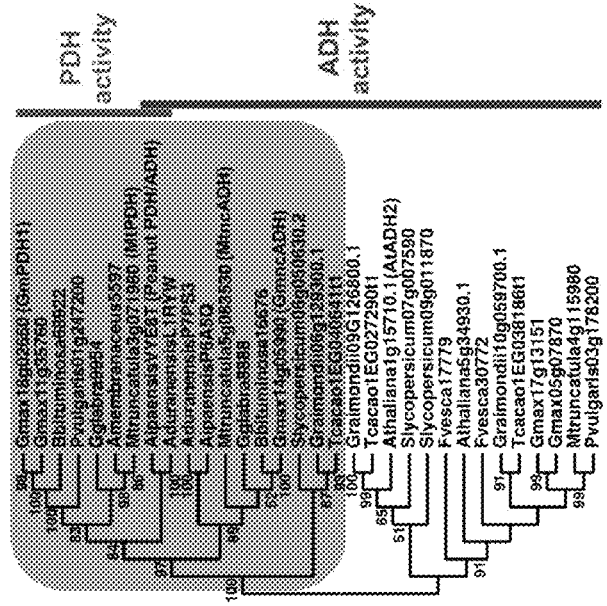
FIGS. 1A-1D show the Tyr biosynthesis pathways in plants and identification and characterization of noncanonical ADHs from legumes.

In one aspect of the present invention, engineered prephenate dehydrogenases (PDH) and arogenate dehydrogenase/prephenate dehydrogenases (ADH/PDH) polypeptides that have increased ADH activity and tyrosine (Tyr) sensitivity are provided. The engineered prephenate dehydrogenase polypeptides or arogenate dehydrogenase/prephenate dehydrogenase (ADH/PDH) polypeptides may include an aspartic acid (D) amino acid residue or a glutamic acid (E) amino acid residue at a position corresponding to amino acid residue 220 of SEQ ID NO: 1 (MtPDH C220D).

In another aspect, engineered arogenate dehydrogenase (ADH) polypeptides that have increased PDH activity and are less sensitive to tyrosine (Tyr) inhibition are provided. The engineered arogenate dehydrogenase polypeptides may include a non-acidic amino acid residue at a position corresponding to amino acid residue 220 of SEQ ID NO: 10 (MtPDH D220C).

In a further aspect, polynucleotides encoding any one of the engineered PDH, PDH/ADH, or ADH dehydrogenase polypeptides disclosed herein are provided.

In another aspect, constructs are provided. The constructs may include a promoter operably linked to any one of the polynucleotides described herein.

In a further aspect, vectors including any of the constructs or polynucleotides described herein are provided.

In another aspect, cells including any of the polynucleotides, constructs, or vectors described herein are provided.

In a further aspect, plants including any of the polynucleotides, constructs, vectors, or cells described herein are also provided.

In a still further aspect, methods for increasing production of at least one product of the tyrosine or HPP pathways in a cell are provided. The methods may include introducing any of the polynucleotides, constructs, or vectors described herein into the cell. Optionally, the methods may further include purifying the product of the tyrosine or HPP pathways from the cells.

DETAILED DESCRIPTION

Here, the present inventors used phylogeny-guided structure-function analyses of ADHs from legumes and eudicots that are phylogenetically related to legume PDHs and identified an active site residue (i.e, the amino acid residue at position 220 of SEQ ID NO: 1 (MtPDH C220D) and the corresponding position in other ADH and PDH polypeptides) that determines prephenate versus arogenate specificity in these enzymes and simultaneously alters Tyr feedback inhibition. The structures of mutant PDH enyzmes co-crystallized with Tyr reveal the molecular basis of TyrA substrate specificity and feedback-regulation that underlies the evolution of two alternative Tyr pathways in plants. Subsequent mutagenesis of the corresponding residue in divergent plant ADHs introduced PDH activity and relaxed Tyr sensitivity, highlighting the critical role of this residue in TyrA substrate specificity underlying the evolution of alternative Tyr biosynthetic pathways in plants.

In one aspect of the present invention, engineered prephenate dehydrogenase (PDH) polypeptides and arogenate dehydrogenase/prephenate dehydrogenase (ADH/PDH) polypeptides that have increased ADH activity and tyrosine (Tyr) sensitivity are provided. The engineered prephenate dehydrogenase polypeptides or arogenate dehydrogenase/prephenate dehydrogenase (ADH/PDH) polypeptides may include an aspartic acid (D) amino acid residue or a glutamic acid (E) amino acid residue at a position corresponding to amino acid residue 220 of SEQ ID NO: 1 (MtPDH C220D).

The engineered PDH polypeptides or ADH/PDH polypeptides may include a polypeptide or a functional fragment thereof having at least 50%, 60%, 70%, 80%, 85%, 90%, 95%, 98%, 99%, or 100% sequence identity to any one of the polypeptides of SEQ ID NOS: 1-9, 121-123, 144-148, 152-158, 213-217, or 243-247 and including an aspartic acid (D) amino acid residue or a glutamic acid (E) amino acid residue at a position corresponding to amino acid residue 220 of SEQ ID NO: 1 (MtPDH C220D).

As used herein, the phrase "at a position corresponding to" refers to an amino acid position that aligns with an amino acid position of another identified sequence in a protein sequence alignment or a protein structure alignment. For example, the phrase "at a position corresponding to amino acid residue 220 of SEQ ID NO: 1 (MtPDH C220D)" refers to an amino acid position in a polypeptide sequence that aligns with the 220$^{th}$ amino acid residue in SEQ ID NO: 1 (MtPDH C220) when the two polypeptide sequences are aligned using common sequence alignment programs. Regarding SEQ ID NOs: 1-55 and 121-158, the amino acid positions in these polypeptide sequences corresponding to amino acid residue 220 of SEQ ID NO: 1 (MtPDH C220D) are shown as the rightmost asterisk in the partial sequence alignment shown in FIG. 3A and as the asterisk in FIG. 12. SEQ ID NOs: 1-55 represent engineered versions of the polypeptides represented in FIG. 3A. SEQ ID NOs: 121-158 represent non-engineered versions of the polypeptides represented in FIG. 12. Thus, SEQ ID NOs: 1-9 are the top nine PDH and PDH/ADH polypeptides shown in the partial sequence alignment in FIG. 3A where the asparagine (N) or cysteine (C) amino acid residue at the position corresponding to amino acid residue 220 of SEQ ID NO: 1 (MtPDH C220D) (the asterisk labeled N222) is substituted with an asparatic acid (D) amino acid residue. SEQ ID NOs: 121-123, 144-148, and 152-158 are the PDH and PDH/ADH polypeptides shown in the partial sequence alignment in FIG. 12. SEQ ID NOs: 10-55 represent the bottom 23 ADH polypeptides shown in the partial sequence alignment in FIG. 3A where the aspartic acid (D) amino acid residue at the position corresponding to amino acid residue 220 of SEQ ID NO: 1 (MtPDH C220D) (the asterisk labeled N222) (also identified as a position corresponding to amino acid residue 220 of SEQ ID NO: 10 (MtncADH D220C)) is substituted with either an asparagine (N) amino acid residue or a cysteine (C) amino acid residue. SEQ ID NOs: 124-143 and 149-151 are the ADH polypeptides shown in the partial sequence alignment in FIG. 12.

Figure 12:
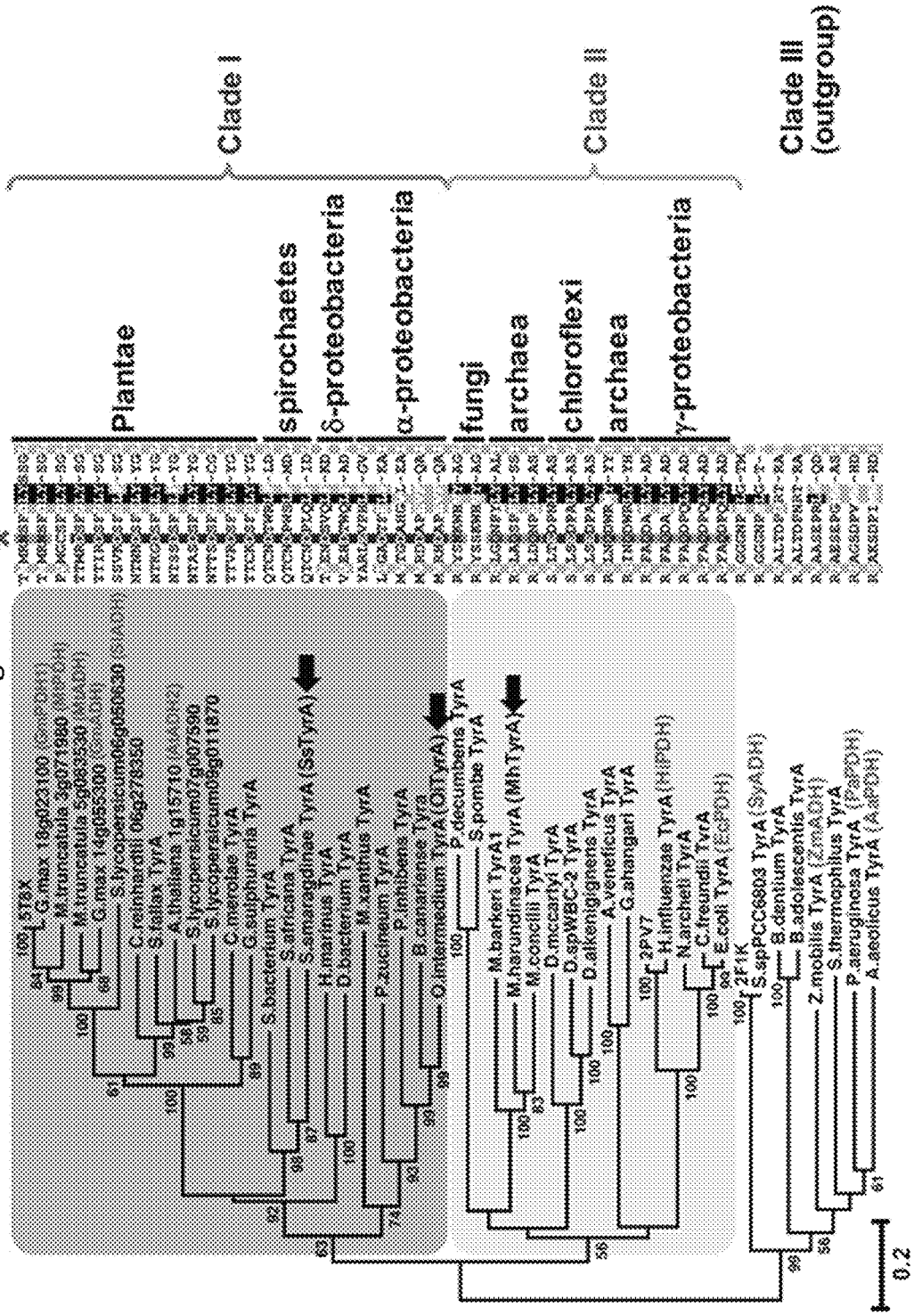
FIG. 12 shows the conserved acidic residue at 222 among clade I TyrA orthologs from plants, algae, and closely-related bacteria in a structure-guided phylogenetic analysis of plant and microbial TyrAs. Three distinct clades are formed; clade I contains all plant TyrAs and closely-related microbes (blue; top shaded square), clade II contains bacteria, archaea, and fungi TyrAs (green; middle shaded square), and clade III (unshaded at bottom), which was used as an outgroup. Enzymes characterized in this study are marked by black arrows. Structures used to guide the alignment are labeled with their PDB IDs. Previously characterized TyrAs are labeled in red with their preferred PDH or ADH activity. Scale bar represents number of substitutions per branch length. A trimmed amino acid alignment of corresponding sequences shows a conserved acidic residue (Asp or Glu, highlighted in blue) among clade I, which is replaced with a non-acidic Asn or Gln residue (highlighted in green) in most clade II (See SEQ ID NOs: 121-166). Identical amino acids present in >50%, black shading; biochemically similar residues present in >50% of the sequences, gray shading.

To determine whether a particular polypeptide sequence has an amino acid residue position "corresponding to" an identified sequence disclosed herein, a person of ordinary skill may align the particular sequence with the sequences described in FIG. 12 (SEQ ID NOs: 121-166) using the methods described in FIG. 12. See, e.g., Pei et al., PRO-MALS: towards accurate multiple sequence alignments of distantly related proteins. *Bioinformatics* 23(7): 802-8 (2007). If the particular sequence falls within clades I or II (SEQ ID NOs: 121-158), then the particular sequence does have an amino acid residue corresponding to the identified sequence disclosed herein, which can be determined by examining the sequence alignment at the appropriate position. If, however, the particular sequence falls within clade III (SEQ ID NOs: 159-166), then the particular sequence does not have an amino acid residue corresponding to the identified sequence disclosed herein.

In the Examples, the present inventors demonstrated that the polypeptides of SEQ ID NOs: 1 and 2 demonstrated a switch in substrate specificity from primarily PDH activity to primarily ADH activity and also introduced Tyr sensitivity into the enzymes. Likewise, the present inventors expect that the polypeptides of SEQ ID NOs: 3-9 would also exhibit increased ADH activity and Tyr sensitivity and that the polypeptides of SEQ ID NOs: 1-9, 121-123, 144-148, 152-158, 213-217, and 243-247, when engineered to include an aspartic acid (D) amino acid residue or a glutamic acid (E) amino acid residue at a position corresponding to amino acid residue 220 of SEQ ID NO: 1 (MtPDH C220D), may also exhibit increased ADH activity and Tyr sensitivity. Thus, in some embodiments, the engineered prephenate dehydrogenases (PDH) and arogenate dehydrogenase/prephenate dehydrogenases (ADH/PDH) polypeptides disclosed herein may have greater arogenate dehydrogenase activity than prephenate dehydrogenase activity. In some embodiments, the arogenate dehydrogenase activity of the engineered prephenate dehydrogenases (PDH) and arogenate dehydrogenase/prephenate dehydrogenase (ADH/PDH) polypeptides may be 1.5, 2, 3, 5, 10, 20, or more fold greater than the prephenate dehydrogenase activity.

As used herein, a polypeptide may "have greater arogenate dehydrogenase activity than prephenate dehydrogenase activity" or "have greater prephenate dehydrogenase activity than arogenate dehydrogenase activity" when the steady-state kinetic parameters ($k_{cat}/K_m$ (mM$^{-1}$ s$^{-1}$)) for arogenate dehydrogenase activity are greater than the steady-state parameters ($k_{cat}/K_m$ (mM$^{1}$ s$^{-1}$)) for prephenate dehydrogenase activity or when the steady-state kinetic parameters ($k_{cat}/K_m$ (mM$^{-1}$ s$^{-1}$)) for prephenate dehydrogenase activity are greater than the steady-state parameters ($k_{cat}/K_m$ (mM$^{-1}$ s$^{-1}$)) for arogenate dehydrogenase activity. Steady-state kinetic parameters may be measured using techniques similar to those described by the inventors in the Examples. Briefly, kinetic parameters of purified polypeptides can be determined from assays conducted at varying arogenate and prephenate concentrations. Standard assay conditions include 25 mM HEPES pH 7.6, 50 mM KCl and 10% (v/v) ethylene glycol, and 0.5 mM NADP$^{+}$ with varied substrate, concentrations. Reactions can be initiated by the addition of the polypeptide and incubated at 37° C. monitored every 10-15 seconds at $A_{340nm}$ using a microplate reader. Kinetic parameters may be determined by fitting initial velocity data to the Michaelis-Menten equation using the Origin software.

In some embodiments, the engineered prephenate dehydrogenases (PDH) and arogenate dehydrogenase/prephenate dehydrogenase (ADH/PDH) polypeptides may include SEQ ID NO: 1 (MtPDH C220D), SEQ ID NO: 2 (GmPDH1 N222D), a polypeptide having at least 50%, 60%, 70%, 80%, 85%, 90%, 95%, 98%, 99% sequence identity to SEQ ID NO: 1 and including an aspartic acid (D) amino acid residue or a glutamic acid (E) residue at position 220 of SEQ ID NO: 1, or a polypeptide having at least 50%, 60%, 70%, 80%, 85%, 90%, 95%, 98%, 99% sequence identity to SEQ ID NO: 2 and including the aspartic acid (D) amino acid residue or a glutamic acid (E) residue at position 222 of SEQ ID NO: 2.

In some embodiments, the engineered prephenate dehydrogenases (PDH) and arogenate dehydrogenase/prephenate dehydrogenase (ADH/PDH) polypeptides may include SEQ ID NO: 1 (MtPDH C220D) or SEQ ID NO: 2 (GmPDH1 N222D).

In another aspect of the present invention, engineered arogenate dehydrogenase (ADH) polypeptides that have increased PDH activity and are less sensitive to tyrosine (Tyr) inhibition are provided. The engineered arogenate dehydrogenase polypeptides may include a non-acidic amino acid residue at a position corresponding to amino acid residue 220 of SEQ ID NO: 10 (MtncADH D220C).

As used herein, a "non-acidic" amino acid may include any amino acid except aspartic acid (D) or glutamic acid (E) and may include, without limitation, Alanine (A), Arginine (R), Asparagine (N), Cysteine (C), Glutamine (Q), Glycine (G), Histidine (H), Isoleucine (I), Leucine (L), Lysine (K), Methionine (M), Phenylalanine (F), Proline (P), Serine (S), Threonine (T), Tryptophan (W), Tyrosine (Y), or Valine (V). In some embodiments, the non-acidic amino acid residue may be an asparagine (N) amino acid residue or a cysteine (C) amino acid residue.

The engineered ADH polypeptides may include a polypeptide or a functional fragment thereof having at least 50%, 60%, 70%, 80%, 85%, 90%, 95%, 98%, 99% sequence identity to any one of the polypeptides of SEQ ID NOs: 10-55, 124-143, 149-151 201-212, or 218-242 and including a non-acidic amino acid residue at a position corresponding to amino acid residue 220 of SEQ ID NO: 10 (MtncADH D220C).

The engineered ADH polypeptides may have greater prephenate dehydrogenase activity than arogenate dehydrogenase activity. In some embodiments, the prephenate dehydrogenase activity of the engineered ADH polypeptides may be 1.5, 2, 3, 5, 10, 20, or more fold greater than the arogenate dehydrogenase activity.

In some embodiments, the engineered ADH polypeptide may include SEQ ID NO: 10 (MtncADH D220C), SEQ ID NO: 11 (MtncADH D220N), SEQ ID NO: 12 (AtADH2 D241N), SEQ ID NO: 13 (AtADH2 D241C), a polypeptide having at least 80% sequence identity to SEQ ID NO: 10 and including a cysteine (C) amino acid residue at position 220 of SEQ ID NO: 10, a polypeptide having at least 80% sequence identity to SEQ ID NO: 11 and including an asparagine (N) amino acid residue at position 220 of SEQ ID NO: 11, a polypeptide having at least 80% sequence identity to SEQ ID NO: 12 and including an asparagine (N) amino acid residue at position 241 of SEQ ID NO: 12, and a polypeptide having at least 80% sequence identity to SEQ ID NO: 13 and including a cysteine (C) amino acid residue at position 241 of SEQ ID NO: 13.

In some embodiments, the engineered ADH polypeptides may include any one of the polypeptides of SEQ ID NOs: 10-13.

The engineered ADH polypeptides having PDH activity may also not be sensitive to tyrosine inhibition. The polypeptide is considered to not be sensitive, i.e. to lack sensitivity to tyrosine feedback inhibition if at least 80% of the activity of the polypeptide in the absence of tyrosine is maintained in the presence of 1 mM tyrosine.

Regarding the engineered PDH, PDH/ADH, or ADH dehydrogenase polypeptides disclosed herein, the phrases "% sequence identity," "percent identity," or "% identity" refer to the percentage of residue matches between at least two amino acid sequences aligned using a standardized algorithm. Methods of amino acid sequence alignment are well-known. Some alignment methods take into account conservative amino acid substitutions. Such conservative substitutions, explained in more detail below, generally preserve the charge and hydrophobicity at the site of substitution, thus preserving the structure (and therefore function) of the polypeptide. Percent identity for amino acid sequences may be determined as understood in the art. (See, e.g., U.S. Pat. No. 7,396,664, which is incorporated herein by reference in its entirety). A suite of commonly used and freely available sequence comparison algorithms is provided by the National Center for Biotechnology Information (NCBI) Basic Local Alignment Search Tool (BLAST® alignment tool), which is available from several sources, including the NCBI, Bethesda, Md., at its website. The BLAST® alignment tool software suite includes various sequence analysis programs including "blastp," that is used to align a known amino acid sequence with other amino acids sequences from a variety of databases.

Polypeptide sequence identity may be measured over the length of an entire defined polypeptide sequence, for example, as defined by a particular SEQ ID number, or may be measured over a shorter length, for example, over the length of a fragment taken from a larger, defined polypeptide sequence, for instance, a fragment of at least 15, at least 20, at least 30, at least 40, at least 50, at least 70 or at least 150 contiguous residues. Such lengths are exemplary only, and it is understood that any fragment length supported by the sequences shown herein, in the tables, figures or Sequence Listing, may be used to describe a length over which percentage identity may be measured.

The engineered PDH, PDH/ADH, or ADH dehydrogenase polypeptides disclosed herein may include "variant" polypeptides, "mutants," and "derivatives thereof." As used herein, a "variant, "mutant," or "derivative" refers to a polypeptide molecule having an amino acid sequence that differs from a reference protein or polypeptide molecule. A variant or mutant may have one or more insertions, deletions, or substitutions of an amino acid residue relative to a reference molecule. For example, an engineered PDH, PDH/ ADH, ADH dehydrogenase polypeptide mutant or variant may have one or more insertion, deletion, or substitution of at least one amino acid residue relative to the reference engineered PDH, PDH/ADH, ADH dehydrogenase polypeptides disclosed herein. The polypeptide sequences of the engineered PDH, PDH/ADH, ADH dehydrogenase polypeptides from various species are presented in SEQ ID NOs: 1-55 and 121-158. These sequences may be used as reference sequences.

The engineered PDH, PDH/ADH, or ADH dehydrogenase polypeptides provided herein may be full-length polypeptides or may be fragments of the full-length polypeptide. As used herein, a "fragment" is a portion of an amino acid sequence which is identical in sequence to, but shorter in length than a reference sequence. A fragment may comprise up to the entire length of the reference sequence, minus at least one amino acid residue. For example, a fragment may comprise from 5 to 1000 contiguous amino acid residues of a reference polypeptide, respectively. In some embodiments, a fragment may comprise at least 5, 10, 15, 20, 25, 30, 40, 50, 60, 70, 80, 90, 100, 150, 250, or 500 contiguous amino acid residues of a reference polypeptide. Fragments may be preferentially selected from certain regions of a molecule. The term "at least a fragment" encompasses the full-length polypeptide. A fragment of an ADH polypeptide may comprise or consist essentially of a contiguous portion of an amino acid sequence of the full-length ADH polypeptide (See, e.g., SEQ ID NOs: 1-55, 121-158, 201-247). A fragment may include an N-terminal truncation, a C-terminal truncation, or both truncations relative to the full-length ADH polypeptide.

A "deletion" in an engineered PDH, PDH/ADH, or ADH dehydrogenase polypeptide refers to a change in the amino acid sequence resulting in the absence of one or more amino acid residues. A deletion may remove at least 1, 2, 3, 4, 5, 10, 20, 50, 100, 200, or more amino acids residues. A deletion may include an internal deletion and/or a terminal deletion (e.g., an N-terminal truncation, a C-terminal truncation or both of a reference polypeptide).

"Insertions" and "additions" in an engineered PDH, PDH/ ADH, or ADH dehydrogenase polypeptide refers to changes in an amino acid sequence resulting in the addition of one or more amino acid residues. An insertion or addition may refer to 1, 2, 3, 4, 5, 10, 20, 30, 40, 50, 60, 70, 80, 90, 100, 150, 200, or more amino acid residues. A variant of an engineered PDH, PDH/ADH, ADH dehydrogenase polypeptide may have N-terminal insertions, C-terminal insertions, internal insertions, or any combination of N-terminal insertions, C-terminal insertions, and internal insertions.

The amino acid sequences of the engineered PDH, PDH/ ADH, or ADH dehydrogenase polypeptide variants, mutants, derivatives, or fragments as contemplated herein may include conservative amino acid substitutions relative to a reference amino acid sequence. For example, a variant, mutant, derivative, or fragment polypeptide may include conservative amino acid substitutions relative to a reference molecule. "Conservative amino acid substitutions" are those substitutions that are a substitution of an amino acid for a different amino acid where the substitution is predicted to interfere least with the properties of the reference polypeptide. In other words, conservative amino acid substitutions substantially conserve the structure and the function of the reference polypeptide. Conservative amino acid substitutions generally maintain (a) the structure of the polypeptide backbone in the area of the substitution, for example, as a beta sheet or alpha helical conformation, (b) the charge or hydrophobicity of the molecule at the site of the substitution, and/or (c) the bulk of the side chain.

The disclosed variant and fragment engineered PDH, PDH/ADH, or ADH dehydrogenase polypeptides described herein may have one or more functional or biological activities exhibited by a reference polypeptide (i.e, SEQ ID NOs: 1-55 or engineered versions of SEQ ID NOs: 121-158). Suitably, the disclosed variant or fragment engineered PDH, PDH/ADH, or ADH dehydrogenase polypeptides retain at least 20%, 40%, 60%, 80%, or 100% of the arogenate dehydrogenase activity or the prephenate dehydrogenase activity of the reference polypeptide (i.e., SEQ ID NOS: 1-55 or engineered versions of SEQ ID NOs: 121-158 or 201-247).

As used herein, a "functional fragment" of an engineered PDH, PDH/ADH, or ADH dehydrogenase polypeptide is a fragment of, for example, one of the polypeptides of SEQ ID NOS: 1-15 that retains at least 20%, 40%, 60%, 80%, or 100% of the arogenate dehydrogenase activity or the prephenate dehydrogenase activity of the full-length polypeptide. Exemplary functional fragments of the engineered PDH, PDH/ADH, or ADH dehydrogenase polypeptides disclosed herein may include, for example, the highly-conserved amino acid residues responsible for NADP$^+$ binding, including the GxGxxG motif, and residues proposed to function in catalysis (e.g. Ser101 and His124). See FIG. 8.

Figure 8:
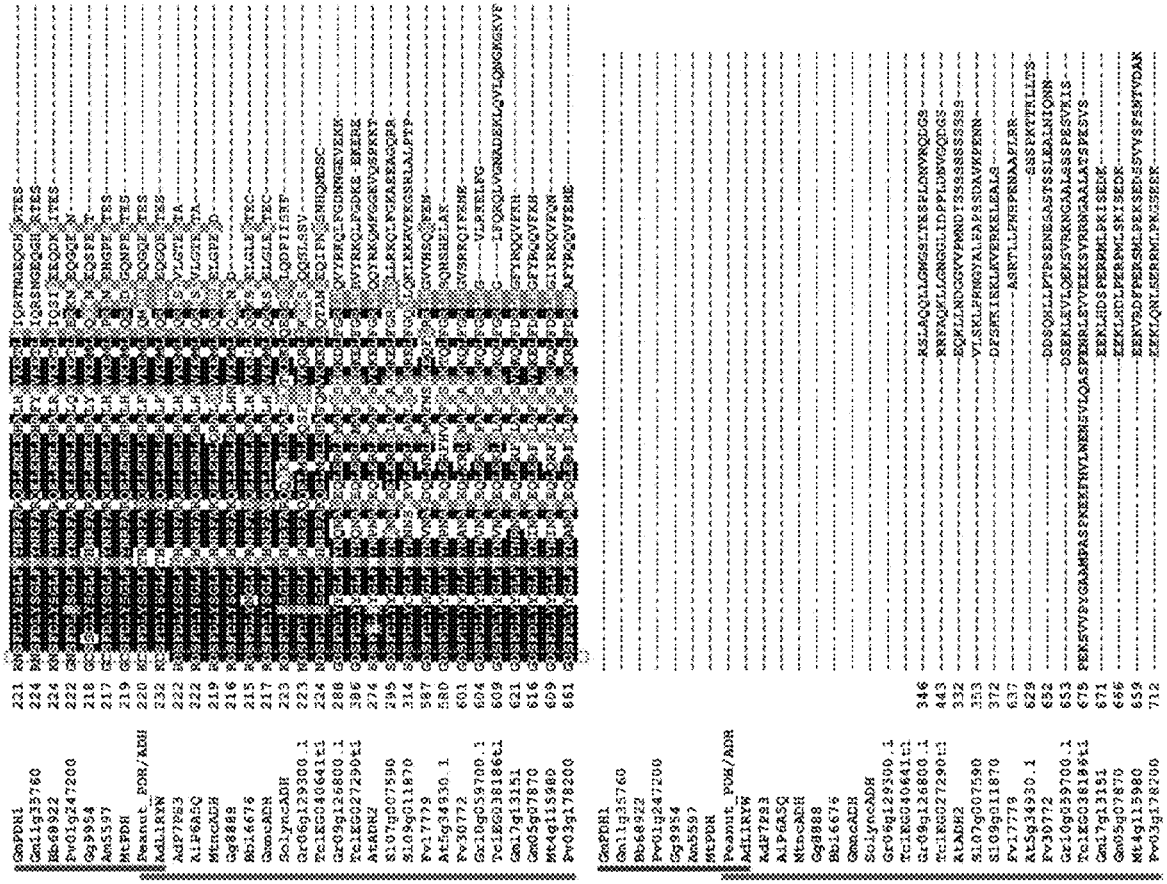
FIG. 8 shows the full amino acid sequence alignment of ADH and PDH homologs (SEQ ID NOs: 169-200). Amino acid sequences used in the phylogeny from FIG. 1B were aligned using ClustalW and shaded using BoxShade. Identical residues that are >50% conserved are shaded black, while biochemically similar residues conserved in >50% of the sequences shaded gray. Key catalytic residues are shown in blue (e.g. Ser101, His124, and His188). The cofactor binding domain is highlighted in blue (GxGxxG), with the NAD(P)(H) discriminator region[16] also boxed in blue. From this study, all plant ADH/PDH enzymes are predicted to have NADP(H) specificity, which has been experimentally verified here and previously[5]. β1e-β1f region is highlighted by a gray bar. Asn222 in GmPDH1 is an Asp in all plant ADHs, whereas Met219 in GmPDH1, which is not 100% conserved in ADHs are shaded in red. As in FIG. 1B, blue bars (top nine sequences) represent enzymes with PDH activity and red bars (bottom sequences) represent enzymes with ADH activity. All numbering is based off the GmPDH1 sequence. The sequences are in the order of the phylogeny in FIG. 1B and accession numbers are from the corresponding database where sequences were obtained Phytozome (phytozome.net) and 1KP (onekp.com). Sequence abbreviations, Ad, *Arachis duranensis*; Ai, *Arachis ipaensis*; Am, *Astragalus membranaceus*; At, *Arabidopsis thaliana*; Bb, *Bituminosa bituminaria*; Fv, *Fragaria vesca*; Gg, *Glycyrrhiza glabra*; Gm, *Glycine max*; Gr, *Gossypium raimondii*; Mt, *Medicago truncatula*; Pv, *Phaseolus vulgaris*; Sl, *Solanum lycopersicum*; Tc, *Theobroma cacao*.

FIG. 8 shows a sequence alignment including the PDH, PDH/ADH, and ADH dehydrogenase polypeptides, which were engineered and disclosed as SEQ ID NOs: 1-55. Based on this alignment it becomes immediately apparent to a person of ordinary skill in the art that various amino acid residues may be altered (i.e. substituted, deleted, etc.) without substantially affecting the arogenate dehydrogenase activity or the prephenate dehydrogenase activity of the polypeptide. For example, a person of ordinary skill in the art would appreciate that substitutions in a reference PDH, PDH/ADH, or ADH dehydrogenase polypeptide could be based on alternative amino acid residues that occur at the corresponding position in other PDH, PDH/ADH, or ADH dehydrogenase polypeptide from other species. For example, the MtPDH polypeptide in FIG. 8 has a threonine amino acid residue at position 57 while some of the other polypeptides in FIG. 8 have a serine, alanine, or other amino acid at this position in the alignment. Thus, one exemplary modification that is apparent from the sequence alignment in FIG. 8 is a T57S or T57A substitution in the disclosed engineered MtPDH polypeptide (SEQ ID NO: 1). Similar modifications could be made to each of SEQ ID NOS: 1-55 at each position of the sequence alignment shown in FIG. 8. Additionally, a person of ordinary skill in the art could easily align other PDH, PDH/ADH, ADH dehydrogenase polypeptides with the polypeptide sequences shown in FIG. 8 to determine what additional variants could be made to the engineered PDH, PDH/ADH, or ADH dehydrogenase polypeptides.

The engineered PDH, PDH/ADH, or ADH dehydrogenase polypeptides contemplated herein may be further modified in vitro or in vivo to include non-amino acid moieties. These modifications may include but are not limited to acylation (e.g., O-acylation (esters), N-acylation (amides), S-acylation (thioesters)), acetylation (e.g., the addition of an acetyl group, either at the N-terminus of the protein or at lysine residues), formylation, lipoylation (e.g., attachment of a lipoate, a C8 functional group), myristoylation (e.g., attachment of myristate, a C14 saturated acid), palmitoylation (e.g., attachment of palmitate, a C16 saturated acid), alkylation (e.g., the addition of an alkyl group, such as an methyl at a lysine or arginine residue), isoprenylation or prenylation (e.g., the addition of an isoprenoid group such as farnesol or geranylgeraniol), amidation at C-terminus, glycosylation (e.g., the addition of a glycosyl group to either asparagine, hydroxylysine, serine, or threonine, resulting in a glycoprotein). Distinct from glycation, which is regarded as a nonenzymatic attachment of sugars, polysialylation (e.g., the addition of polysialic acid), glypiation (e.g., glycosylphosphatidylinositol (GPI) anchor formation, hydroxylation, iodination (e.g., of thyroid hormones), and phosphorylation (e.g., the addition of a phosphate group, usually to serine, tyrosine, threonine or histidine) are enzymatic or covalent attachments.

Polynucleotides encoding any one of the engineered PDH, PDH/ADH, or ADH dehydrogenase polypeptides disclosed herein are provided. As used herein, the terms "polynucleotide," "polynucleotide sequence," "nucleic acid" and "nucleic acid sequence" refer to a nucleotide, oligonucleotide, polynucleotide (which terms may be used interchangeably), or any fragment thereof. These phrases also refer to DNA or RNA of natural or synthetic origin (which may be single-stranded or double-stranded and may represent the sense or the antisense strand). The polynucleotides may be cDNA or genomic DNA.

Polynucleotides homologous to the polynucleotides described herein are also provided. Those of skill in the art understand the degeneracy of the genetic code and that a variety of polynucleotides can encode the same polypeptide. In some embodiments, the polynucleotides (i.e., polynucleotides encoding the engineered PDH, PDH/ADH, or ADH dehydrogenase polypeptides) may be codon-optimized for expression in a particular cell including, without limitation, a plant cell, bacterial cell, or fungal cell. While particular polynucleotide sequences which are found in plants are disclosed herein any polynucleotide sequences may be used which encode a desired form of the polypeptides described herein. The particular polynucleotide sequences of the non-engineered PDH, PDH/ADH, or ADH dehydrogenase polypeptides are provided as SEQ ID NOS: 56-96. Thus non-naturally occurring sequences may be used. These may be desirable, for example, to enhance expression in heterologous expression systems of polypeptides or proteins. Computer programs for generating degenerate coding sequences are available and can be used for this purpose. Pencil, paper, the genetic code, and a human hand can also be used to generate degenerate coding sequences.

In another aspect of the present invention, constructs are provided. As used herein, the term "construct" refers to recombinant polynucleotides including, without limitation, DNA and RNA, which may be single-stranded or double-stranded and may represent the sense or the antisense strand. Recombinant polynucleotides are polynucleotides formed by laboratory methods that include polynucleotide sequences derived from at least two different natural sources or they may be synthetic. Constructs thus may include new modifications to endogenous genes introduced by, for example, genome editing technologies. Constructs may also include recombinant polynucleotides created using, for example, recombinant DNA methodologies.

The constructs provided herein may be prepared by methods available to those of skill in the art. Notably each of the constructs claimed are recombinant molecules and as such do not occur in nature. Generally, the nomenclature used herein and the laboratory procedures utilized in the present invention include molecular, biochemical, and recombinant DNA techniques that are well known and commonly employed in the art. Standard techniques available to those skilled in the art may be used for cloning, DNA and RNA isolation, amplification and purification. Such techniques are thoroughly explained in the literature.

The constructs provided herein may include a promoter operably linked to any one of the polynucleotides described herein. The promoter may be a heterologous promoter or an endogenous promoter associated with the PDH, PDH/ADH, or ADH dehydrogenase polypeptide.

As used herein, the terms "heterologous promoter," "promoter," "promoter region," or "promoter sequence" refer generally to transcriptional regulatory regions of a gene, which may be found at the 5' or 3' side of the ADH polynucleotides described herein, or within the coding region of the ADH polynucleotides, or within introns in the ADH polynucleotides. Typically, a promoter is a DNA regulatory region capable of binding RNA polymerase in a cell and initiating transcription of a downstream (3' direction) coding sequence. The typical 5' promoter sequence is bounded at its 3' terminus by the transcription initiation site and extends upstream (5' direction) to include the minimum number of bases or elements necessary to initiate transcription at levels detectable above background. Within the promoter sequence is a transcription initiation site (conveniently defined by mapping with nuclease Si), as well as protein binding domains (consensus sequences) responsible for the binding of RNA polymerase.

In some embodiments, the disclosed PDH, PDH/ADH, or ADH dehydrogenase polynucelotides are operably connected to the promoter. As used herein, a polynucleotide is "operably connected" or "operably linked" when it is placed into a functional relationship with a second polynucleotide sequence. For instance, a promoter is operably linked to a PDH, PDH/ADH, or ADH dehydrogenase polynucelotide if the promoter is connected to the PDH, PDH/ADH, or ADH dehydrogenase polynucelotide such that it may effect transcription of the PDH, PDH/ADH, or ADH dehydrogenase polynucelotides. In various embodiments, the PDH, PDH/ADH, or ADH dehydrogenase polynucelotides may be operably linked to at least 1, at least 2, at least 3, at least 4, at least 5, or at least 10 promoters.

Heterolgous promoters useful in the practice of the present invention include, but are not limited to, constitutive, inducible, temporally-regulated, developmentally regulated, chemically regulated, tissue-preferred and tissue-specific promoters. The heterologous promoter may be a plant, animal, bacterial, fungal, or synthetic promoter. Suitable promoters for expression in plants include, without limitation, the 35S promoter of the cauliflower mosaic virus, ubiquitin, tCUP cryptic constitutive promoter, the Rsyn7 promoter, pathogen-inducible promoters, the maize In2-2 promoter, the tobacco PR-1a promoter, glucocorticoid-inducible promoters, estrogen-inducible promoters and tetracycline-inducible and tetracycline-repressible promoters. Other promoters include the T3, T7 and SP6 promoter sequences, which are often used for in vitro transcription of RNA. In mammalian cells, typical promoters include, without limitation, promoters for Rous sarcoma virus (RSV), human immunodeficiency virus (HIV-1), cytomegalovirus (CMV), SV40 virus, and the like as well as the translational elongation factor EF-1α promoter or ubiquitin promoter. Those of skill in the art are familiar with a wide variety of additional promoters for use in various cell types. In some embodiments, the heterologous promoter includes a plant promoter, either endogenous to the plant host or heterologous.

Vectors including any of the constructs or polynucleotides described herein are provided. The term "vector" is intended to refer to a polynucleotide capable of transporting another polynucleotide to which it has been linked. In some embodiments, the vector may be a "plasmid," which refers to a circular double-stranded DNA loop into which additional DNA segments may be ligated. Certain vectors are capable of autonomous replication in a host cell into which they are introduced (e.g., bacterial vectors having a bacterial origin of replication and episomal mammalian vectors). Other vectors can be integrated into the genome of a host cell upon introduction into the host cell, and thereby be replicated along with the host genome, such as some viral vectors or transposons. Plant mini-chromosomes are also included as vectors. Vectors may carry genetic elements, such as those that confer resistance to certain drugs or chemicals.

Cells including any of the polynucleotides, constructs, or vectors described herein are provided. Suitable "cells" that may be used in accordance with the present invention include eukaryotic or prokaryotic cells. Suitable eukaryotic cells include, without limitation, plant cells, fungal cells, and animal cells. Suitable prokaryotic cells include, without limitation, gram-negative and gram-positive bacterial species. In some embodiments, the cell is a plant cell such as, without limitation, a beet plant cell, a soybean plant cell, a mung bean plant cell, an opium poppy plant cell, an alfalfa plant cell, a rice plant cell, a wheat plant cell, a corn plant cell, a sorghum plant cell, a barley plant cell, a millet plant cell, an oat plant cell, a rye plant cell, a rapeseed plant cell, and a miscanthus plant cell. In some embodiments, the cell is a bacterial or fungal cell. For example, the polynucleotides, constructs, or vectors described herein may be introduced into yeast cells to improve the production of opioids such as morphine. See, e.g., Galanie et al., DOI: 10.1126/science.aac9373, Published Online Aug. 13, 2015.

Plants including any of the polynucleotides, constructs, vectors, or cells described herein are also provided. Suitable plants may include, without limitation, a beet plant, a soybean plant, a mung bean plant, an opium poppy plant, an alfalfa plant, a rice plant, a wheat plant, a corn plant, a sorghum plant, a barley plant, a millet plant, an oat plant, a rye plant, and a rapeseed plant as well as perennial grasses such as a miscanthus plant. For example, polynucleotides encoding any one of the engineered PDH, PDH/ADH, or ADH dehydrogenase polypeptides of SEQ ID NOs: 1-55 may be used to generate transgenic plants.

Portions or parts of these plants are also useful and provided. Portions and parts of plants includes, without limitation, plant cells, plant tissue, plant progeny, plant asexual propagates, plant seeds. The plant may be grown from a seed comprising transgenic cells or may be grown by any other means available to those of skill in the art. Chimeric plants comprising transgenic cells are also provided and encompassed.

As used herein, a "plant" includes any portion of the plant including, without limitation, a whole plant, a portion of a plant such as a part of a root, leaf, stem, seed, pod, flower, cell, tissue plant germplasm, asexual propagate, or any progeny thereof. Germplasm refers to genetic material from an individual or group of individuals or a clone derived from a line, cultivar, variety or culture. Plant refers to whole plants or portions thereof including, without limitation, plant cells, plant protoplasts, plant tissue culture cells or calli. For example, a soybean plant refers to whole soybean plant or portions thereof including, without limitation, soybean plant cells, soybean plant protoplasts, soybean plant tissue culture cells or calli. A plant cell refers to cells harvested or derived from any portion of the plant or plant tissue culture cells or calli.

Methods for increasing production of at least one product of the tyrosine or HPP pathways in a cell are provided. The methods may include introducing any of the polynucleotides, constructs, or vectors described herein into the cell. Suitable products of the tyrosine or HPP pathways include, without limitation, vitamin E, plastoquinone, a cyanogenic glycoside, a benzylisoquinoline alkaloid, rosmarinic acid, betalains, suberin, mescaline, morphine, salidroside, a phenylpropanoid compound, dhurrin, a tocochromanol, ubiquinone, lignin, a catecholamine such as epinephrine (adrenaline) or dopamine (i.e., L-dihydroxyphenylalanine (L-DOPA)), melanin, an isoquinoline alkaloid, hydroxycinnamic acid amide (HCAA), an amaryllidaceae alkaloid, hordenine, hydroxycinnamate, hydroxylstyrene, or tyrosine. Phenylpropanoid compounds (i.e., lignin, tannins, flavonoids, stilbene) may be produced from tyrosine, for example, by combining the polypeptides disclosed herein with a tyrosine-ammonia lyase (TAL) or by using cells that naturally have a TAL such as grass cells.

As used herein, "introducing" describes a process by which exogenous polynucleotides (e.g., DNA or RNA) are introduced into a recipient cell. Methods of introducing polynucleotides into a cell are known in the art and may include, without limitation, microinjection, transformation, and transfection methods. Transformation or transfection may occur under natural or artificial conditions according to various methods well known in the art, and may rely on any known method for the insertion of foreign nucleic acid sequences into a host cell. The method for transformation or transfection is selected based on the type of host cell being transformed and may include, but is not limited to, the floral dip method, *Agrobacterium*-mediated transformation, bacteriophage or viral infection, electroporation, heat shock, lipofection, and particle bombardment. Microinjection of polynucleotides may also be used to introduce polynucleotides into cells.

In some embodiments, the present methods may further include purifying the product of the tyrosine or HPP pathways from the cells. As used herein, the term "purifying" is used to refer to the process of ensuring that the product of the tyrosine or HPP pathways is substantially or essentially free from cellular components and other impurities. Purification of products of the tyrosine or HPP pathways is typically performed using analytical chemistry techniques such as high performance liquid chromatography and other chromatographic techniques. Methods of purifying such products are well known to those skilled in the art. A "purified" product of the tyrosine or HPP pathways means that the product is at least 85% pure, more preferably at least 95% pure, and most preferably at least 99% pure.

The present disclosure is not limited to the specific details of construction, arrangement of components, or method steps set forth herein. The compositions and methods disclosed herein are capable of being made, practiced, used, carried out and/or formed in various ways that will be apparent to one of skill in the art in light of the disclosure that follows. The phraseology and terminology used herein is for the purpose of description only and should not be regarded as limiting to the scope of the claims. Ordinal indicators, such as first, second, and third, as used in the description and the claims to refer to various structures or method steps, are not meant to be construed to indicate any specific structures or steps, or any particular order or configuration to such structures or steps. All methods described herein can be performed in any suitable order unless otherwise indicated herein or otherwise clearly contradicted by context. The use of any and all examples, or exemplary language (e.g., "such as") provided herein, is intended merely to facilitate the disclosure and does not imply any limitation on the scope of the disclosure unless otherwise claimed. No language in the specification, and no structures shown in the drawings, should be construed as indicating that any non-claimed element is essential to the practice of the disclosed subject matter. The use herein of the terms "including," "comprising," or "having," and variations thereof, is meant to encompass the elements listed thereafter and equivalents thereof, as well as additional elements. Embodiments recited as "including," "comprising," or "having" certain elements are also contemplated as "consisting essentially of" and "consisting of" those certain elements.

Recitation of ranges of values herein are merely intended to serve as a shorthand method of referring individually to each separate value falling within the range, unless otherwise indicated herein, and each separate value is incorporated into the specification as if it were individually recited herein. For example, if a concentration range is stated as 1% to 50%, it is intended that values such as 2% to 40%, 10% to 30%, or 1% to 3%, etc., are expressly enumerated in this specification. These are only examples of what is specifically intended, and all possible combinations of numerical values between and including the lowest value and the highest value enumerated are to be considered to be expressly stated in this disclosure. Use of the word "about" to describe a particular recited amount or range of amounts is meant to indicate that values very near to the recited amount are included in that amount, such as values that could or naturally would be accounted for due to manufacturing tolerances, instrument and human error in forming measurements, and the like. All percentages referring to amounts are by weight unless indicated otherwise.

No admission is made that any reference, including any non-patent or patent document cited in this specification, constitutes prior art. In particular, it will be understood that, unless otherwise stated, reference to any document herein does not constitute an admission that any of these documents forms part of the common general knowledge in the art in the United States or in any other country. Any discussion of the references states what their authors assert, and the applicant reserves the right to challenge the accuracy and pertinence of any of the documents cited herein. All references cited herein are fully incorporated by reference in their entirety, unless explicitly indicated otherwise. The present disclosure shall control in the event there are any disparities between any definitions and/or description found in the cited references.

Unless otherwise specified or indicated by context, the terms "a", "an", and "the" mean "one or more." For example, "a protein" or "an RNA" should be interpreted to mean "one or more proteins" or "one or more RNAs," respectively.

The following examples are meant only to be illustrative and are not meant as limitations on the scope of the invention or of the appended claims.

EXAMPLES

Example 1—Molecular Basis of the Evolution of Alternative Tyrosine Biosynthetic Pathways in Plants This Example is based on data reported in Schenck et al., "Molecular basis of the evolution of alternative tyrosine biosynthetic routes in plants," *Nat. Chem. Biol.*, 13(9):1029-1035 (2017), the contents of which (including all supplemental data, figures, and associated materials) is incorporated herein by reference.

L-Tyrosine (Tyr) is essential for protein synthesis and a precursor of numerous specialized metabolites crucial for plant and human health. Tyr can be synthesized via two alternative routes by a key regulatory TyrA family enzyme, prephenate or arogenate dehydrogenase (PDH/TyrA$_p$ or ADH/TyrA$_a$), representing a unique divergence of primary metabolic pathways. However, the molecular foundation underlying the evolution of the alternative Tyr pathways is currently unknown. Here we characterized recently-diverged plant PDH and ADHs, obtained the x-ray crystal structure of soybean PDH, and identified a single amino acid residue that defines TyrA substrate specificity and regulation. Structures of mutated PDHs co-crystallized with Tyr indicate that substitutions of Asn222 confers ADH activity and Tyr-sensitivity. Subsequent mutagenesis of the corresponding residue in divergent plant ADHs introduced PDH activity and relaxed Tyr sensitivity, highlighting the critical role of this residue in TyrA substrate specificity underlying the evolution of alternative Tyr biosynthetic pathways in plants.

Unlike recently-evolved and lineage-specific diverse specialized (secondary) metabolic pathways[1], primary metabolism such as amino acid biosynthesis are ubiquitous and usually conserved among organisms. However, there are some exceptions to this notion[2,3], and L-tyrsosine (Tyr) biosynthetic pathway is one example in which variations have long been described in microbes and plants[4,5]. Elucidation of evolutionary diversification of primary metabolism not only addresses the extent of metabolic plasticity but also provides useful engineering tools to modify core metabolic pathways.

Tyr is an essential aromatic amino acid required for protein synthesis in all organisms but, synthesized de novo only in plants and microorganisms[6,7]. Neurotransmitters such as catecholamines in metazoans are derived from Tyr, which must be obtained from their diet, as they cannot synthesize Tyr de novo[8]. In plants, Tyr serves as the precursor to numerous specialized metabolites crucial for both plant and human health, such as antioxidants vitamin E, the photosynthetic electron carrier plastoquinone, betalain pigments, and defense compounds, including dhurrin, rosmarinic acid, and isoquinoline alkaloids (e.g. morphine)[9-14]. The major plant cell wall component lignin can also be synthesized from Tyr in grasses[15].

Tyr is synthesized from prephenate, a shikimate pathway product, by two reactions, an oxidative decarboxylation and a transamination (FIG. 1A). The TyrA enzymes catalyze the oxidative decarboxylation step and are the key regulatory enzymes of Tyr biosynthesis, as they are usually inhibited by Tyr and compete for substrates that are also used in L-phenylalanine biosynthesis (FIG. 1A)[16-18]. In many microbes an NAD(H)-dependent prephenate dehydrogenase/TyrA (PDH/TyrA$_p$; EC 1.3.1.13) converts prephenate into 4-hydroxyphenylpyruvate (HPP) followed by transamination to Tyr by Tyr aminotransferase (TAT, FIG. 1A)[18]. In plants, these two reactions occur in the reverse order, with prephenate first being transaminated to arogenate by prephenate aminotransferase (PPA-AT), followed by oxidative decarboxylation to Tyr by an NADP(H)-dependent arogenate dehydrogenase/TyrA (ADH/TyrA$_a$; EC 1.3.1.78, FIG. 1A)[19-24]. Some exceptions to these "textbook" models are found in nature including microbes that use ADH to synthesize Tyr[25,26] and plants such as legumes having PDH activity[5,27,28]. Also, some microbial TyrAs prefer NADP(H) cofactor[18,29]. Thus, variations exist in the TyrA enzymes in diverse organisms, yet the molecular basis underlying TyrA substrate specificity and the alternative Tyr pathways is currently unknown.

Comparison of microbial TyrA sequences identified an aspartate residue downstream of the NAD(P)(H) binding motif that was later shown to confer cofactor specificity of TyrA[16,30]. Site-directed mutagenesis of *Escherichia coli* PDH and structural analysis of *Aquifex aeolicus* PDH identified an active site histidine, which interacts with substrate C4-hydroxyl and is critical for catalysis in each PDH. The same studies also showed that an active site arginine is necessary for substrate binding, but not for substrate specificity[31-34]. Besides their varied substrate and cofactor specificities, TyrA enzymes also exhibit different regulatory properties. Mutation of another active site histidine, which is present in the *E. coli* and *A. aeolicus* PDHs but absent in Tyr-insensitive *Synechocystis* ADH, relieved Tyr inhibition but simultaneously reduced PDH activity[34]. Random mutagenesis of the *E. coli* enzyme identified additional residues that relaxed Tyr inhibition; however, PDH activity was also reduced in these mutants[35]. Sequence and structural comparisons of divergent TyrA homologs have been unable to identify specific determinants of Tyr-sensitivity and substrate specificity[16,29,30,33,34].

Recent work described legume PDHs that were insensitive to Tyr regulation[5]. Here, we used phylogeny-guided structure-function analyses of ADHs from legumes and eudicots that are phylogenetically related to legume PDHs and identified an active site residue that determines prephenate versus arogenate specificity in these enzymes and simultaneously alters Tyr inhibition. The structures of mutant PDH enyzmes co-crystallized with Tyr reveal the molecular basis of TyrA substrate specificity and feedback-regulation that underlies the evolution of two alternative Tyr pathways in plants.

Results

Identification and Biochemical Analysis of Noncanonical ADH in Legumes

Figure 1B:
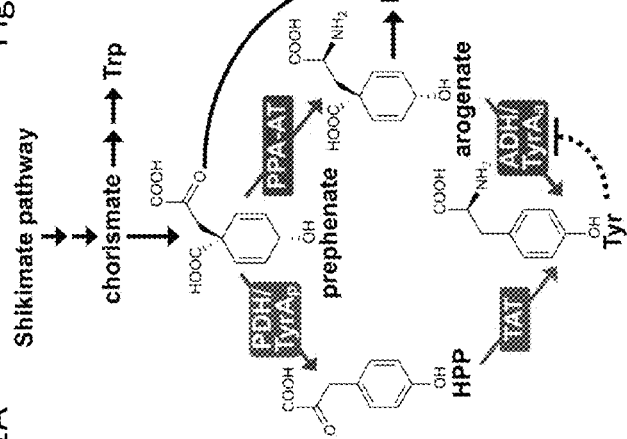
Figure 1D:
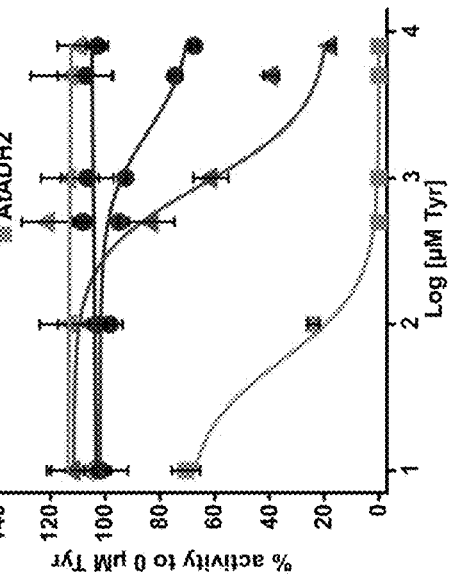
Figure 1C:
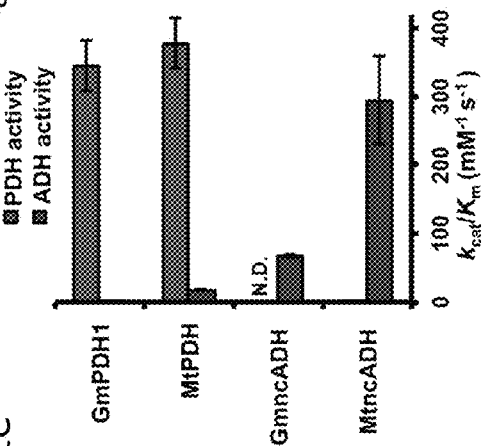

Our previous phylogenetic analysis of plant TyrA enzymes (hereafter referred to as either ADH or PDH) identified a "noncanonical" clade (gray box in FIG. 1B) containing legume PDHs that was distinct from the "canonical" ADHs present in all plant lineages[5]. The "noncanonical" clade also contained additional homologs from some eudicots (FIG. 1B). For comparison of the biochemical properties of PDHs and their noncanonical TyrA homologs, representative members of each group were expressed as recombinant proteins and purified for steady-state kinetic analysis and compared with previously characterized canonical ADHs (FIG. 1C; Table 1). PDHs from *Glycine max* (soybean; GmPDH1; 18g02650) and *Medicago truncatula* (MtPDH; 3g071980) preferred prephenate versus arogenate as substrates with 139-fold and 21-fold higher $k_{cat}/K_m$ values, respectively. The noncanonical TyrA homolog from soybean (Gm14g05990) only displayed activity with arogenate, whereas that from *M. truncatula* (Mt5g083530) accepted both substrates but was 6,200-fold more efficient with arogenate, similar to previously characterized ADH from *Arabidopsis thaliana* (AtADH2; At1g15710)[19]. Thus, Gm14g05990 and Mt5g083530 are noncanonical ADHs (GmncADH and MtncADH, respectively). Each of the legume noncanonical ADH used NADP⁺ over NAD⁺ as cofactor (FIG. 6) consistent with previously reported plant ADH and PDHs[5,19,23]. In addition to substrate specificity, these three types of plant ADHs and PDHs differ in feedback inhibition by Tyr (FIG. 1D; Table 1)[5]. The canonical AtADH2, was highly sensitive to Tyr (IC$_{50}$=38 μM), whereas GmPDH1 and MtPDH were insensitive to feedback inhibition by Tyr (up to 8 mM in assays) (FIG. 1D). The noncanonical ADHs, GmncADH and MtncADH, are sensitive to Tyr but with IC$_{50}$ values in the mM range. Thus, unlike PDHs, legume noncanonical ADHs are partially inhibited by Tyr.

TABLE 1

Steady-state kinetic parameters and effect of tyrosine on representative plant ADH and PDH.

| protein | substrate | $k_{cat}$ (s$^{-1}$) | $K_m$ (mM) | $k_{cat}/K_m$ (M$^{-1}$ s$^{-1}$) | IC$_{50}^{Tyr}$ (mM) |
|---|---|---|---|---|---|
| GmPDH1 | prephenate | 30.4 ± 0.7 | 0.09 ± 0.01 | 337,800 | — |
|  | arogenate | 6.3 ± 0.7 | 2.59 ± 0.09 | 2,430 | 31.3 ± 9.3 |
| MtPDH1 | prephenate | 18.5 ± 3.0 | 0.05 ± 0.01 | 370,000 | — |
|  | arogenate | 16.9 ± 1.1 | 0.94 ± 0.04 | 17,980 | 32.1 ± 10.0 |
| Peanut PDH/ADH | prephenate | 2.8 ± 0.2 | 0.19 ± 0.01 | 14,740 | — |
|  | arogenate | 3.2 ± 0.1 | 0.28 ± 0.03 | 11,430 | — |
| GmncADH | prephenate | — | — | — | — |
|  | arogenate | 27.7 ± 1.1 | 0.41 ± 0.03 | 67,560 | 15.5 ± 0.8 |
| MtncADH | prephenate | 0.3 ± 0.1 | 6.69 ± 0.27 | 45 | 0.6 ± 0.1 |
|  | arogenate | 39.0 ± 7.6 | 0.14 ± 0.02 | 278,600 | 2.2 ± 0.5 |
| SolyncADH | prephenate | — | — | — | — |
|  | arogenate | 15.9 ± 2.1 | 0.45 ± 0.05 | 35,330 | 12.8 ± 2.0 |

Figure 7A:
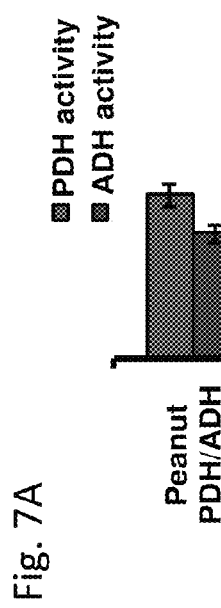
FIGS. 7A-7B show the biochemical characterization of peanut and tomato noncanonical ADH/PDHs.
Figure 7B:
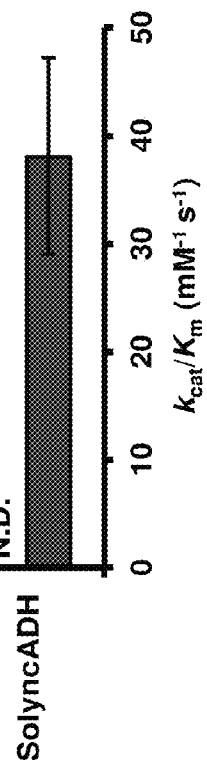

To further define the phylogenetic boundaries of noncanonical ADH and PDHs additional homologs from *Arachis ipaensis* (peanut; AipaensisVYE8T) and *Solanum lycopersicum* (tomato; Slycopersicum06g050630), which exist at key phylogenetic boundaries (FIG. 1B), were biochemically characterized. AipaensisVYE8T (peanut PDH/ADH) used both arogenate and prephenate to similar degrees ($k_{cat}/K_m$=11.6 and 14.9 mM$^{-1}$ s$^{-1}$, respectively), whereas Slycopersicum06g050630 (SolyncADH) exhibited ADH but not PDH activity (FIG. 7A). Peanut PDH/ADH was insensitive to Tyr inhibition, whereas SolyncADH showed relaxed sensitivity to Tyr with an IC$_{50}$=12.8 mM (FIG. 7B; Table 1), similar to legume ncADHs. Thus, legume enzymes having considerable PDH activity are Tyr insensitive and form a subclade within the noncanonical clade likely due to a recent gene duplication of an ncADH within legumes (FIG. 1B).

X-Ray Crystal Structure of Soybean PDH

Figure 2A:
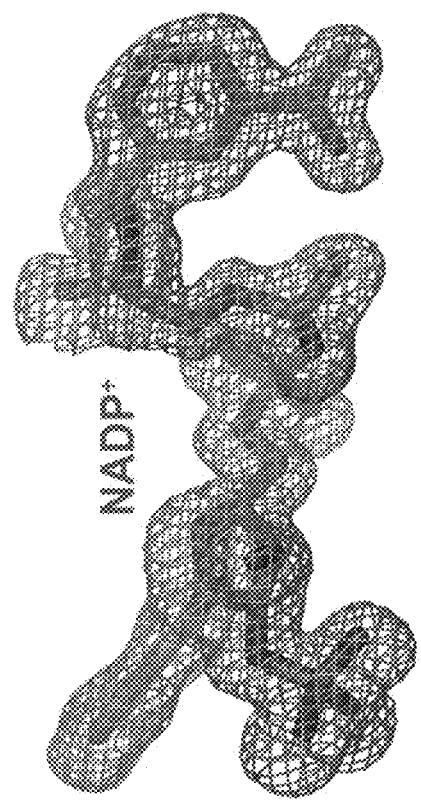
FIGS. 2A-2D show the X-ray crystal structure of GmPDH1.

To understand the structure-sequence relationship of legume PDHs and ADHs, and because TyrA structures from plants are not available, the x-ray crystal structure of GmPDH1 was determined by single-wavelength anomalous dispersion phasing using selenomethionine-substituted protein (Table 2). The resulting model was then used for molecular replacement with a 1.69 Å resolution native data set to solve the structure of the GmPDH1•NADP$^+$•citrate complex (FIG. 2A; Table 2). GmPDH1 forms a homodimer with each 257 amino acid monomer adopting a N-terminal Rossman fold domain (residues 8-171) that shapes the NADP(H)-binding domain and an α-helical C-terminal dimerization domain (residues 172-257) (FIG. 2A). The PDH dimer is formed by two tail-to-tail monomers that pack closely resulting in a dumbbell-shaped molecule (FIG. 2A). The N-terminal domain is made up of seven β-strands sandwiched between two sets of three α-helices. The C-terminal dimerization domain consists of an entirely helical architecture of four α-helices. The active site in each monomer is found at the interface of the two domains.

TABLE 2

Summary of crystallographic data.

| Crystal | GmPDH1 (SeMet)•NADP$^+$ | GmPDH1•NADP$^+$•citrate | GmPDH1 N222D•NADP$^+$•Tyr | GmPDH1 M219T/ N222D•NADP$^+$•Tyr |
|---|---|---|---|---|
| Space group | P1 | P1 | P1 | P1 |
| Cell dimensions | a = 46.51, b = 55.13, c = 68.59 Å; α = 107.3°, β = 98.9°, γ = 103.6° | a = 46.00, b = 55.28, c = 67.94 Å; α = 107.4°, β = 98.9°, γ = 103.2° | a = 46.46, b = 55.05, c = 68.39 Å; α = 107.8°, β = 99.6°, γ = 102.6° | a = 46.29, b = 54.60, c = 68.09 Å; α = 107.0°, β = 99.3°, γ = 103.7° |
| Date collection |  |  |  |  |
| Wavelength (Å) | 0.979 | 0.979 | 0.979 | 0.979 |
| Resolution range (Å) (highest shell) | 34.1-2.03 (2.06-2.03) | 32.4-1.69 (1.72-1.69) | 33.9-1.99 (2.05-1.99) | 34.0-1.69 (1.72-1.69) |
| Reflections (total/unique) | 67,565/37,512 | 126,889/64,687 | 62,159/36,694 | 106,188/59,535 |
| Completeness (highest shell) | 96.0% (88.7%) | 97.0% (94.6%) | 88.9% (85.3%) | 88.9% (87.2%) |
| <I/σ> (highest shell) | 7.6 (1.6) | 13.8 (1.1) | 10.2 (2.3) | 12.3 (1.7) |
| $R_{sym}$ (highest shell) | 6.1% (43.2%) | 4.4% (43.9%) | 8.5% (28.5%) | 4.9% (34.4%) |
| Refinement |  |  |  |  |
| $R_{cryst}/R_{free}$ | 18.8%/22.9% | 15.3%/18.2% | 15.8%/20.6% | 15.4%/18.4% |
| No. of protein atoms, waters, ligand atoms | 4017, 224, 96 | 4094, 604, 122 | 4054, 435, 122 | 4084, 616, 122 |
| Root mean square deviation, bond lengths (Å) | 0.010 | 0.007 | 0.008 | 0.007 |

TABLE 2-continued

Summary of crystallographic data.

| Crystal | GmPDH1 (SeMet)•NADP+ | GmPDH1•NADP+•citrate | GmPDH1 N222D•NADP+•Tyr | GmPDH1 M219T/ N222D•NADP+•Tyr |
|---|---|---|---|---|
| Root mean square deviation, bond angles (°) | 1.17 | 1.17 | 0.91 | 0.98 |
| Average B-factor ($Å^2$) protein, ligand, solvent | 29.1, 25.3, 37.4 | 23.7, 19.6, 37.5 | 32.5, 32.0, 41.3 | 21.4, 15.3, 37.3 |
| Stereochemistry, most favored, allowed, outliers | 97.8, 2.2, 0.0% | 97.7, 2.3, 0.0% | 97.8, 2.2, 0.0% | 97.5, 2.5, 0.0% |

Figure 2B:
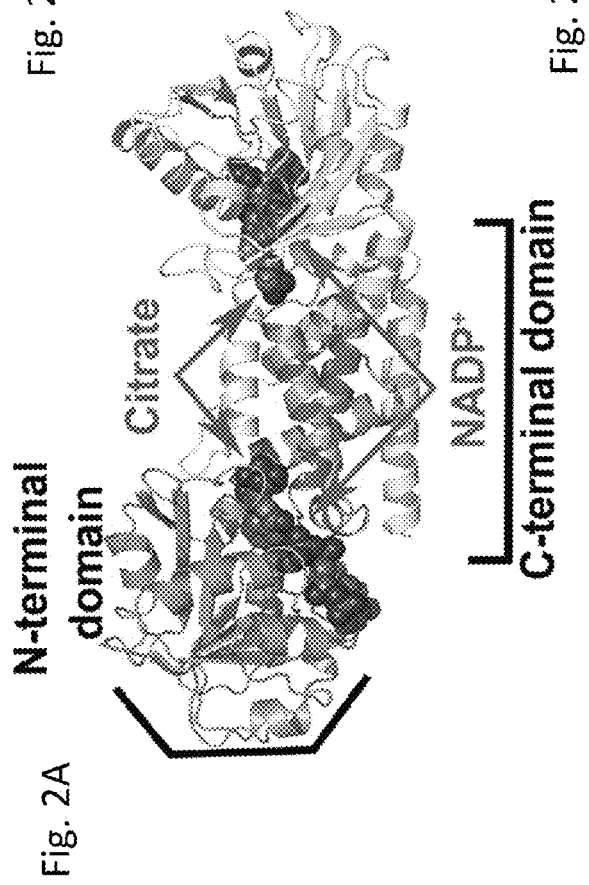
Figure 2C:
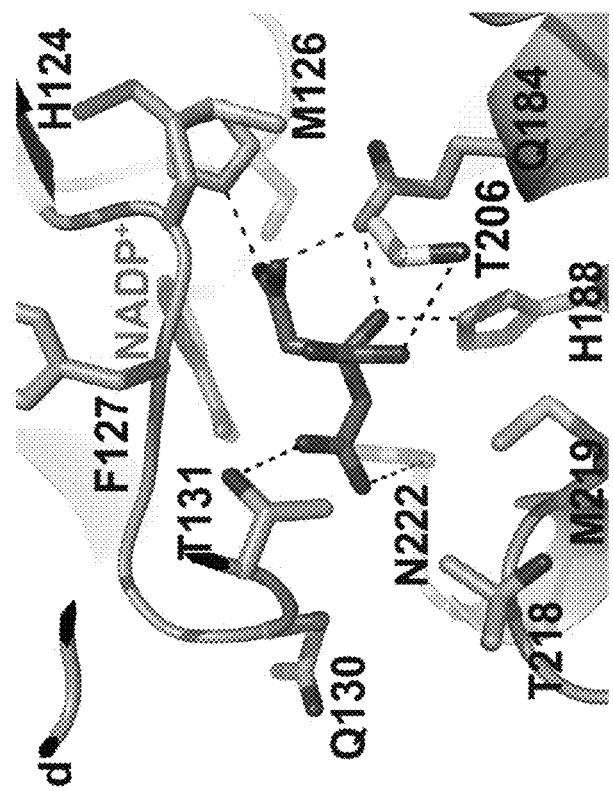

Consistent with the NADP+ specificity of GmPDH1[5], the crystal structure of GmPDH1 shows clear electron density for this ligand in the N-terminal domain of each monomer (FIG. 2B) and extensive protein-ligand binding interactions (FIG. 2C). The (β1a-α1 loop (residues 16-21) is the conserved GxGxxG motif characteristic of NAD(P)(H)-dependent oxidoreductases' and contributes interactions with the pyrophosphate moiety and the nicotinamide ring. The main-chain amides of Asn19 and Phe20 hydrogen bond with an oxygen atom in the diphosphate linker. The hydroxyl group of Ser223 interacts with another phosphate oxygen. Additionally, contacts with five water molecules further stabilize the disphosphate linker. The syn-conformation of the nicotinamide ring is stabilized by 7C-7C stacking interactions with Phe20 and by polar contacts between N1 and the side-chain of Ser101. Water molecules also interact with the carboxamide oxygen and nitrogen. These interactions orient the B-face of the nicotinamide ring toward the substrate binding pocket.

Other interactions complete the cofactor binding site (FIG. 2C). The adenine ring, which is in the anti-conformation, hydrogen bonds to the side-chain of Glu80 and a water molecule through its exocyclic N6 and to the hydroxyl group of Thr73 via N3 and N9. Water molecules form polar interactions with the adenine N3 and N7. Extensive charge-charge interactions are formed between the 2'-phosphate of the adenine ribose and the side-chain of Arg40, the hydroxyl groups of Ser39, Ser41, and Tyr43, the backbone amide nitrogen of Ser41, and three water molecules. These interactions form the phosphate binding site that favors NADP (H) over NAD(H). The 3'-phosphate of the adenine ribose interacts with the main-chain amide of Gly18 and the ring oxygen of the ribose hydrogen bonds to the hydroxyl group of Thr73. Both the adenine ribose and the nicotinamide ribose adopt the C2'-endo conformation. The 2'-hydroxyl of the nicotinamide ribose interacts with the side-chain hydroxyl and the main-chain nitrogen of Ser101, whereas the 3'-hydroxyl of the nicotinamide ribose hydrogen bonds to the backbone oxygen of Thr73. A water molecule interacts with the 2'- and 3'-hydroxyls of the nicotinamide ribose.

Figure 2D:
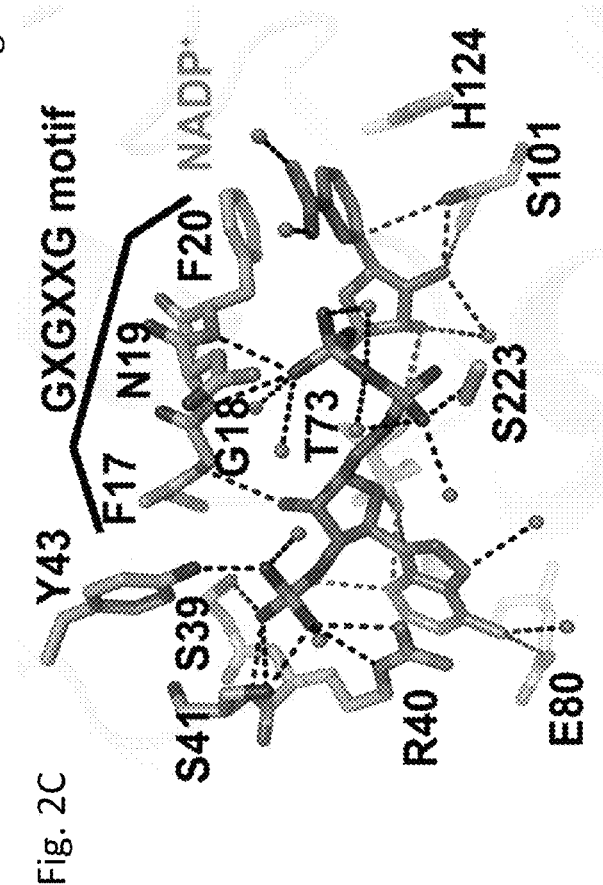

Although efforts to obtain crystals with different substrate molecules (e.g. prephenate and HPP) were not successful, the structure of PDH complexed with NADP+ and citrate, contributed from the crystallization buffer, suggests how substrates may bind within the active site (FIG. 2D). The citrate is positioned in a pocket proximal to the nicotinamide ring and the putative catalytic histidine (His124). The Nε of His124 and the side-chain amine of Gln184 form polar contacts with the α-carboxyl group of citrate. Similarly, the side-chain nitrogen of Gln184 and Nε of His188 contact the γ-hydroxyl of citrate. The ζ-carboxyl group of citrate interacts with the hydroxyl of Thr206, which is provided by the other subunit at the dimer interface. Additional polar contacts are made between the 6-carboxyl and the hydroxyl of Thr131 and the side-chain amine of Asn222. The binding of citrate, which mimics the dicarboxylate portion of prephenate, identifies potential residues in the substrate binding site.

Identification of a Residue that Confers TyrA Substrate Specificity

Next, the predicted substrate binding site (FIG. 2D) and the phylogenetic distribution of PDH and ADHs (FIG. 1B) were used together to identify residues responsible for differences in substrate specificity. Amino acid alignment of the plant TyrA enzymes (FIG. 8) showed highly conserved residues responsible for NADP+ binding, including the GxGxxG motif, and residues proposed to function in catalysis (e.g. Ser101 and His124)[31-34]. Within the PDH active site, residues uniquely conserved in either ADHs or PDHs were also identified (FIG. 3A; FIG. 8). Asp218 in GmncADH, which corresponds to Asn222 in GmPDH1, was highly conserved among ADHs but not in PDHs (FIG. 3A). Similarly, Thr215 of GmncADH was generally conserved among ADHs but replaced by either Met or Val in PDHs (Met219 in GmPDH1); however, peanut PDH/ADH retains a Thr at the corresponding position (FIG. 3A). These comparisons suggest that either Met219 or Asn222 (or both) may determine prephenate specificity in PDH.

To experimentally test the roles of the two residues in PDH versus ADH substrate specificity, site-directed mutagenesis was performed on GmPDH1 to convert Asn222 and Met219 into the corresponding residues in GmncADH (N222D and M219T). The M219T mutant had very similar kinetic parameters to wild-type enzyme preferring prephenate over arogenate substrate (FIG. 3B; Table 3). The N222D mutant, however, showed a 115-fold reduction in $k_{cat}/K_m$ with prephenate and gained ADH activity (FIG. 3B; Table 3). The turnover rate ($k_{cat}$) of N222D for arogenate (27.8 $s^{-1}$) was comparable to wild-type GmPDH1 and GmncADH for prephenate and arogenate, respectively (30.4 and 27.7 $s^{-1}$; Table 1). The M219T/N222D double mutant, exhibited very similar $k_{cat}/K_m$ values for PDH and ADH activity compared to the N222D single mutant (FIG. 3B; Table 3), suggesting that the M219T substitution had little effect on substrate specificity alone or in combination with the N222D mutation.

TABLE 3

Steady-state kinetic parameters and effect of tyrosine on mutant GmPDH1, MtPDH1, GmncADH, MtncADH, and SolyncADH.

| protein | substrate | $k_{cat}$ (s$^{-1}$) | $K_m$ (mM) | $k_{cat}/K_m$ (M$^{-1}$ s$^{-1}$) | $IC_{50}^{Tyr}$ (mM) |
|---|---|---|---|---|---|
| GmPDH1 M219T | prephenate | 30.3 ± 0.8 | 0.10 ± 0.02 | 303,000 | — |
|  | arogenate | 4.6 ± 0.3 | 1.55 ± 0.14 | 2,968 | — |
| GmPDH1 N222D | prephenate | 19.1 ± 1.4 | 7.58 ± 1.13 | 2,520 | 5.3 ± 0.4 |
|  | arogenate | 27.8 ± 3.5 | 0.53 ± 0.18 | 52,450 | 4.7 ± 0.4 |
| GmPDH1 N222A | prephenate | 6.6 ± 0.3 | 0.19 ± 0.04 | 34,740 | — |
|  | arogenate | — | — | — | — |
| GmPDH1 M219T/N222D | prephenate | 2.5 ± 0.3 | 1.18 ± 0.12 | 2,119 | 11.1 ± 1.2 |
|  | arogenate | 29.0 ± 4.4 | 0.63 ± 0.18 | 46,030 | 5.9 ± 0.5 |
| MtPDH C220D | prephenate | 0.5 ± 0.1 | 1.53 ± 0.09 | 327 | 8.2 ± 0.9 |
|  | arogenate | 46.8 ± 4.2 | 0.27 ± 0.01 | 173,300 | — |
| GmncADH D218N | prephenate | 11.5 ± 0.5 | 1.98 ± 0.05 | 5,810 | — |
|  | arogenate | 8.6 ± 0.2 | 0.74 ± 0.14 | 11,620 | — |
| MtncADH D220C | prephenate | 10.1 ± 0.5 | 0.74 ± 0.03 | 13,650 | — |
|  | arogenate | 7.0 ± 0.8 | 0.87 ± 0.03 | 8,046 | 7.7 ± 1.5 |
| SolyncADH D224N | prephenate | 2.4 ± 1.0 | 2.31 ± 0.10 | 1,040 | — |
|  | arogenate | 11.7 ± 0.2 | 1.34 ± 0.48 | 8,730 | — |

To test if the analogous mutation alters substrate specificity outside of soybean PDH, the Asp residue was introduced to the corresponding Cys on MtPDH. Similar to the GmPDH1 N222D mutant, the C220D mutation reduced PDH activity and enhanced ADH activity (FIG. 3B), which is reflected by 31-fold higher and 3-fold lower $K_m$ toward prephenate and arogenate, respectively, compared to wild-type (Tables 1 and 3). To examine if an acidic Asp residue was necessary for converting PDH to ADH activity, an alanine mutation was introduced at Asn222 in GmPDH1 (N222A). The N222A mutant reduced PDH activity, but did not introduce ADH activity, unlike N222D (FIG. 3B; Table 3). These results suggest that the corresponding 222 position in legume PDH enzymes is the key determinant for their substrate specificity, where an acidic Asp residue is crucial for ADH activity.

Altered Substrate Specificity Simultaneously Affects Tyr-Sensitivity

The mutations on legume PDHs were also tested for their effect on Tyr sensitivity. Similar to GmPDH1, the M219T and N222A single mutants, which did not alter substrate specificity, were not inhibited by Tyr (FIG. 3C; Table 3). In contrast, the GmPDH1 N222D and M219T/N222D mutants, as well as the MtPDH C220D mutant, exhibited Tyr inhibition with $IC_{50}$ values of 5 to 11 mM (FIG. 3C; Table 3). Thus, mutating Asn222 and Cys220 of GmPDH1 and MtPDH, respectively, into an Asp not only introduced ADH activity, but also Tyr sensitivity.

Figure 4A:
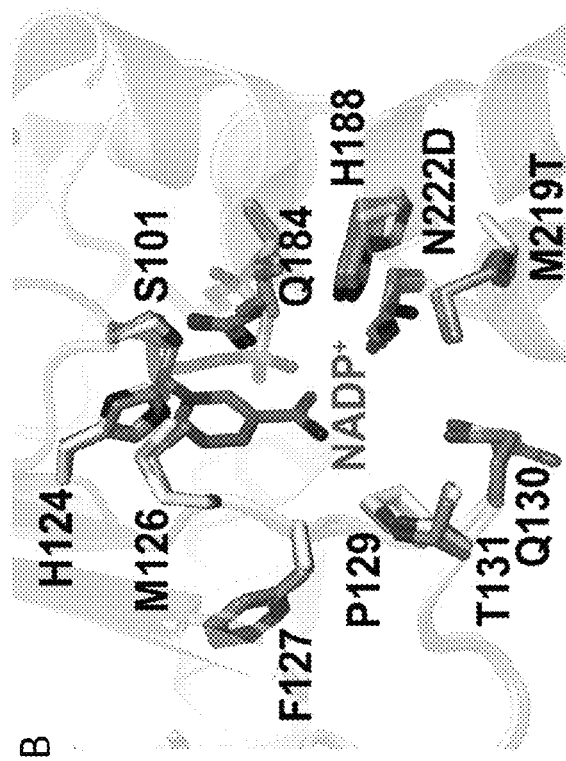
FIGS. 4A-4D show the crystal structures of GmPDH1 N222D and M219T/N222D to reveal Tyr binding interactions.
Figure 4B:
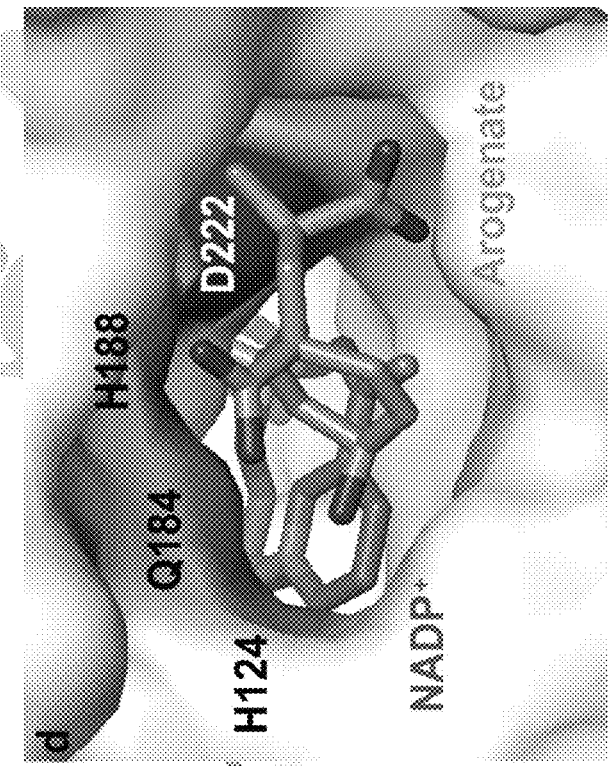

The GmPDH1 mutants that bind to Tyr can now be used to test the role of the active site Asp222 in ADH activity and Tyr sensitivity. The GmPDH1 N222D and M219T/N222D mutants were successfully co-crystalized with Tyr and NADP$^+$ bound in their active site at 1.99 and 1.69 Å resolution, respectively (Table 2). An overlay of these two mutants with the wild-type structure revealed no global conformational changes (FIG. 4A). Likewise, the substitutions did not drastically alter the active site structure of either mutant (FIG. 4B).

Figure 4C:
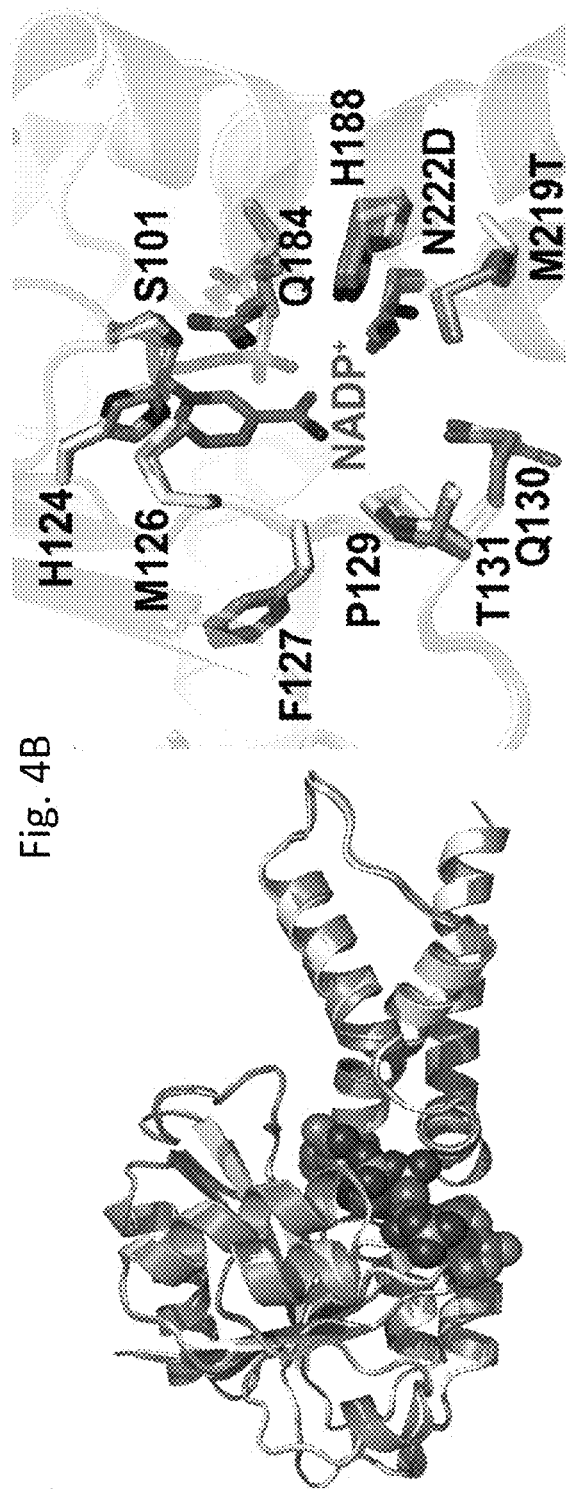

In the GmPDH1 M219T/N222D structure, the ring hydroxyl of the Tyr ligand contacts NE of His124, the hydroxyl of Ser101, and the amine group of Gln184 (FIG. 4C). The side chain carboxylate of Tyr interacts with the hydroxyl group and backbone amide of Thr131, as well as the carboxylate and backbone amide of Gln130. The position of the bound Tyr is also stabilized by π-π stacking iteration with the nicotinamide ring of NADP$^+$. The amine nitrogen of Tyr forms polar contacts with a water molecule, the carbonyl of Gln130, and the carboxylate of the mutated Asp222 residue. Identical contacts were observed in the GmPDH1 N222D structure. Neither Met219 nor the mutated Thr219 makes a direct contact with the ligand.

Figure 4D:
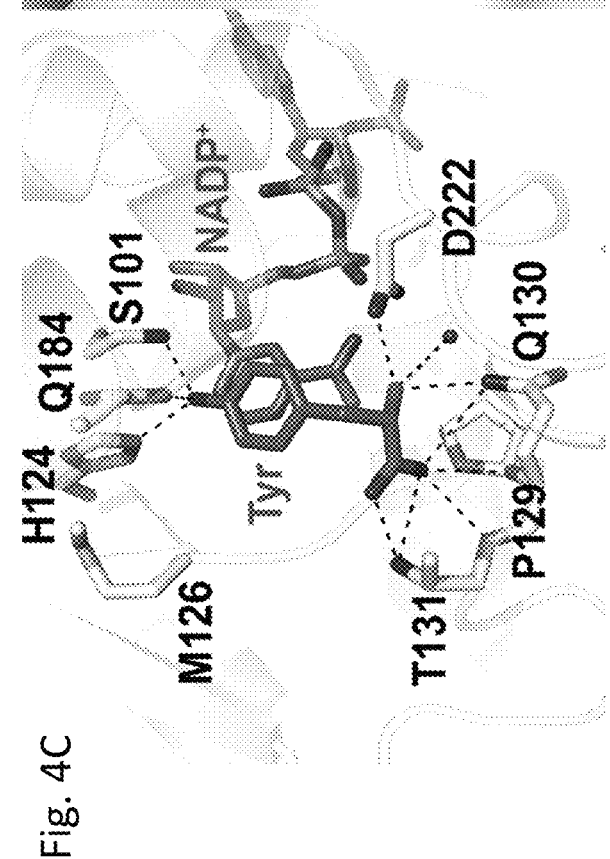

In the GmPDH1 mutant structures, the active site pocket near the site of hydride transfer from the substrate to the nicotinamide via His124 is composed of a wall of nitrogen atoms (i.e. of Gln184 and His188), and Asp222 adds a negatively charged region to the side of the pocket to recognize the amine of Tyr (FIG. 4C). Computational docking of arogenate into the crystallographic structure of GmPDH1 M219T/N222D shows that the hydroxyl of arogenate can anchor itself between His124 and the nicotinamide ring, similar to Tyr (FIG. 4D). Also, the carboxylate of Asp222 forms a polar interaction with the amine of arogenate (FIG. 4D). By mutating the 222 residue from a positively charged Asn to a negatively charged Asp, the specificity in substrate recognition changes to preferentially recognize the amine of arogenate over the carbonyl of prephenate and also introduce sensitivity to Tyr.

Mutating Asp218 Introduces PDH Activity in Divergent Plant ADH Enyzmes

Figure 5A:
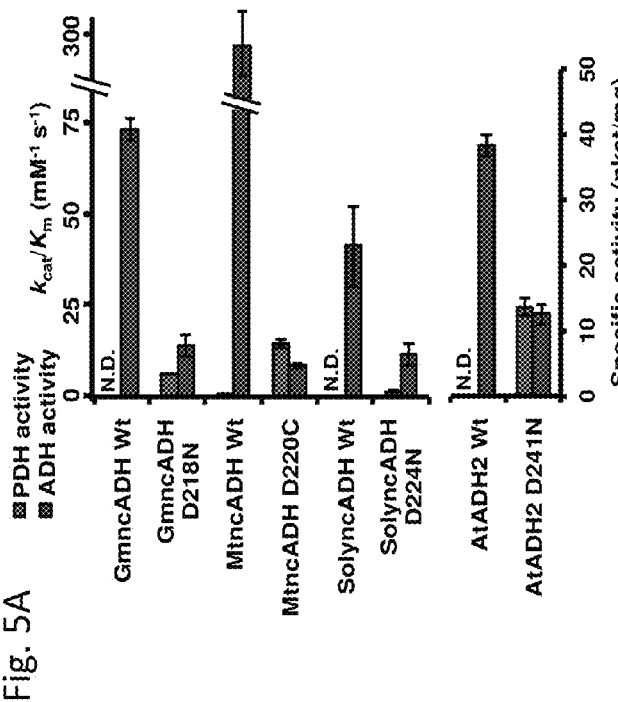
FIGS. 5A-5B show that Asn222 confers PDH activity to divergent plant ADHs while simultaneously introducing Tyr sensitivity.

To test if PDH activity can be introduced to legume ncADHs, the reciprocal mutation was made on GmncADH at position Asp218 (corresponding to Asn222 of GmPDH1) to generate the D218N mutant. The D218N substitution reduced $k_{cat}/K_m$ for ADH by ~6-fold (FIG. 5A; Table 3) while introducing PDH activity (FIG. 5A) into an enzyme which was originally unable to use prephenate (FIG. 1C; Table 1). The corresponding Asp to Cys mutation on MtncADH (D220C) showed similar results, e.g. reduced ADH activity and enhanced PDH activity (FIG. 5A). While wild-type MtncADH had a 6,190-fold preference for arogenate, MtncADH D220C was switched to prefer prephenate over arogenate by 1.7-fold (Table 3). These results further confirm the role of Asp218 and Asn222 in ADH and PDH activity, respectively.

Figure 5B:
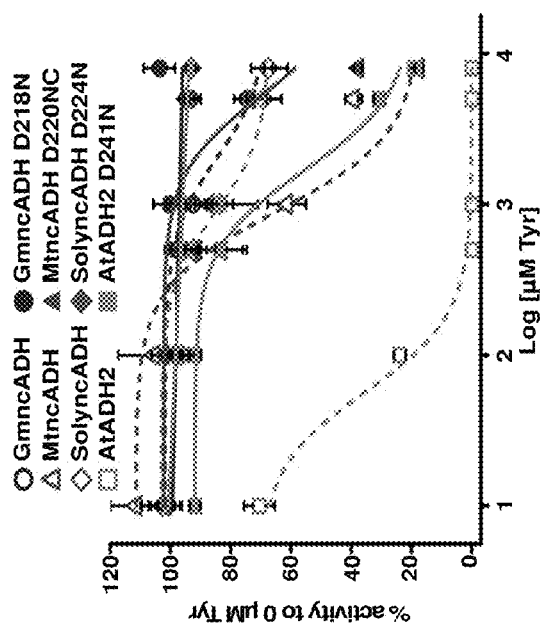

The corresponding Asp residue was also mutated to Asn in divergent ADH from the basal noncanonical clade, tomato (SolyncADH D224N), and canonical ADH clade, Arabidopsis (AtADH2 D241N) (FIG. 1B). Similar to the results observed with the legume ncADHs, the tomato and Arabidopsis mutant enzymes gained PDH activity at the expense of ADH activity (FIG. 5A; Table 3). Additionally, each of the ADH mutants (GmncADH D218N, MtncADH D220C, SolyncADH D224N, and AtADH2 D241N) were significantly less sensitive to Tyr inhibition than the respective wild-type enzymes (FIG. 5B; Tables 1 and 3). Thus, the alteration of the key active site Asp residue is the evolutionary switch needed to introduce PDH activity in diverse plant ADH enzymes while simultaneously relieving feedback inhibition by Tyr.

Discussion

In plants, aromatic amino acid biosynthesis provides essential building blocks for proteins and diverse primary and specialized metabolites[6,7]; however, the biochemical pathways for production of these compounds can vary, as exemplified in Tyr biosynthesis. While all plants have canonical ADH for Tyr synthesis[5-7,19,37], our studies found that some eudicots have noncanonical ADH (ncADH) and some legumes additionally have PDH (FIG. 1B-1C)[5]. The three types of TyrA dehydrogenases share similar catalytic properties, but with distinct arogenate versus prephenate specificities (FIG. 1C; Table 1; FIGS. 7 & 8)[5,19,24,27,28]. Moreover, the final pathway product, Tyr, strongly feedback inhibits the canonical ADHs and partially inhibits the ncADHs (FIG. 1D), whereas the legume PDHs are completely insensitive to Tyr (FIG. 1D)[5]. Also, unlike plastid-localized canonical ADHs[19,37,38], ncADH and PDH lack an N-terminal chloroplast transit peptide and localize in the cytosol[5], as were also shown for cytosolic CM and TAT isoforms that function before and after PDH, respectively[39,40]. While we are currently investigating the physiological functions of the cytosolic PDH and ADH pathways using genetic approaches, our data suggest that alternative Tyr pathways having distinct regulation and localization evolved in different plants.

Figure 9A:
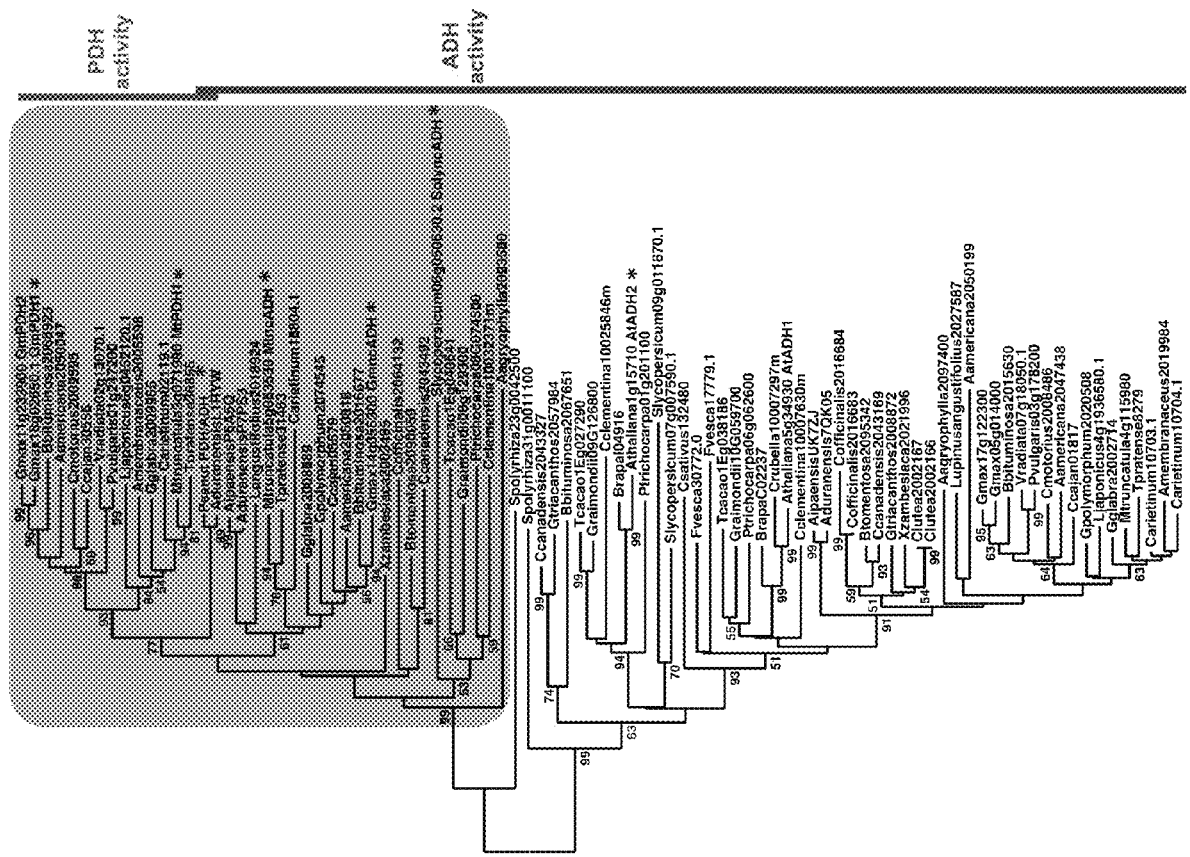
FIGS. 9A-9B show the extended phylogenetic analysis of plant TyrA homologs and distribution in Leguminosae.
Figure 9B:
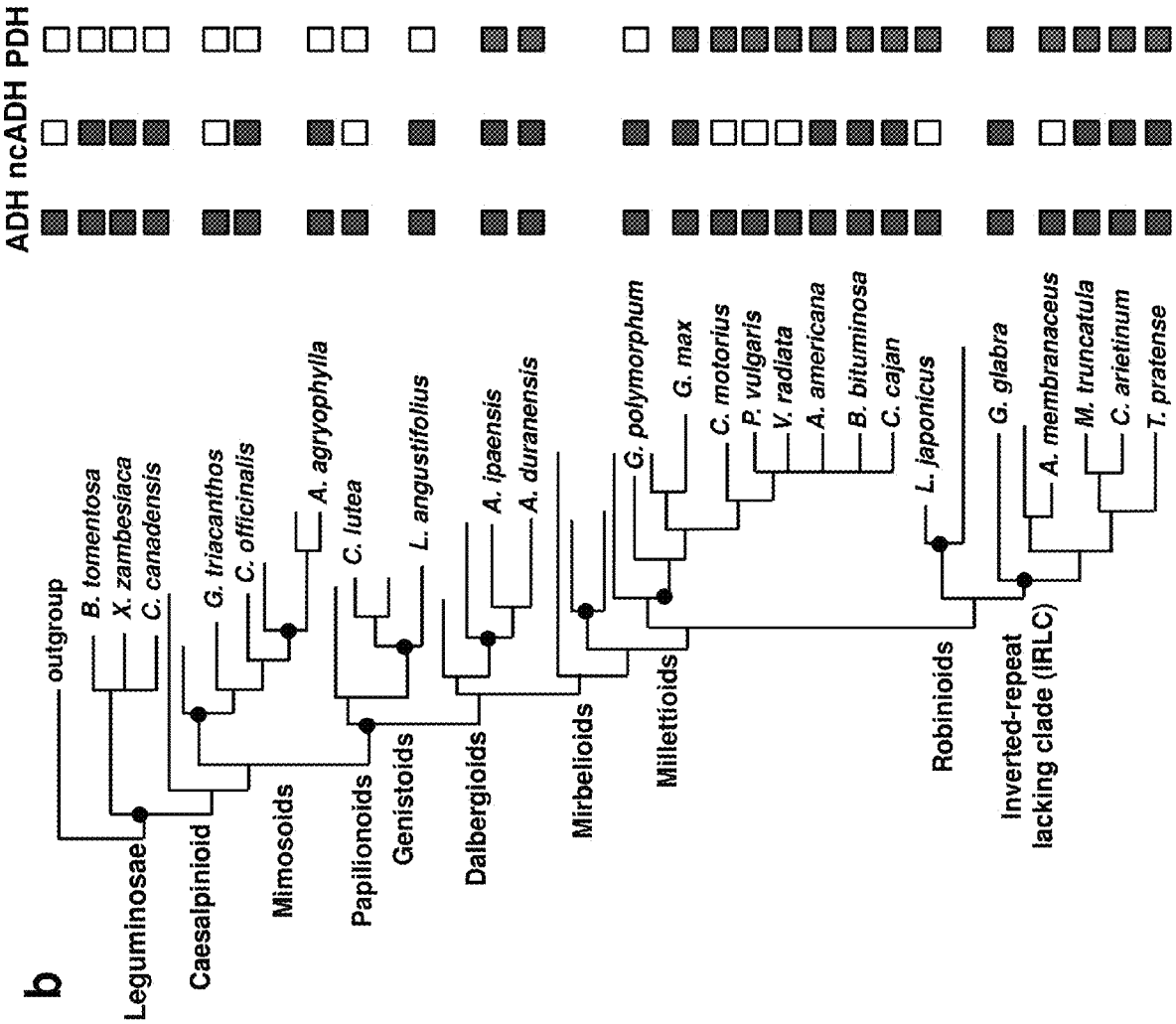

Previous work showed that the legume PDH genes evolved through duplication of an ancestral plant ADH gene, followed by subfunctionalization, rather than horizontal gene transfer of a bacterial PDH gene[5]. PDH enzymes are restricted to legumes, particularly in the more recently-diverged species, such as peanut and soybean (FIG. 1B; FIG. 9)[41,42]. Therefore, the PDH genes evolved through an ancient duplication event giving rise to the eudicot noncanonical clade, which was followed by a second duplication within the legume family (FIG. 1B, FIG. 9).

The current study demonstrates that alteration of Asp222 (into Asn or Cys) played a key role during the subfunctionalization of the duplicated gene from ADH to PDH (FIGS. 3 and 5). Comparison of the x-ray crystal structures of the wild type and N222D mutants of GmPDH1 (FIGS. 2 and 4) showed that the Asp substitution is readily accommodated in the active site without significant conformational changes (FIGS. 4A, 4B). Prephenate and arogenate are nearly identical with the exception of a carbonyl versus an amine, respectively (FIG. 1A). Positioning of the carboxylate side-chain of the Asp residue in the GmPDH1 mutants provides an energetically dominant ionic interaction with the amine of arogenate substrate (FIG. 4D), which would be protonated at physiological pH, compared to a hydrogen bond with the prephenate carbonyl group in the wild-type enzyme. The same charge-charge interaction is also critical for feedback inhibition in the GmPDH1 mutants (FIG. 3C; Table 3) and binding with Tyr, which also has the side-chain amine (FIG. 4C).

Although introduction of Asp218 into GmPDH1 restored ADH activity near wild-type levels of GmncADH ($k_{cat}/K_m$ of 52.5 vs 67.5, respectively FIG. 3B, Tables 1 and 3), that of Asn222 into GmncADH was insufficient to obtain PDH activity comparable to wild-type GmPDH1 level (FIGS. 3B and 5A). An additional mutation of Met219, which covaries with Asn222, on GmPDH1 wild-type and N222D mutant did not enhance ADH activity (FIG. 3B). Comparisons among GmPDH1, GmncADH, and AtADH2 reveal variety in the amino acid sequence of the 131e-131f loop (Phe127 to Trp136 in GmPDH1, FIG. 8), which is at the opposing side of the active site from Asn222 and consists of residues that interact with the ligand side chain carboxylate (FIG. 4B). Thus, residues on the β1e-β1f loop could be contributing to the correct positioning of the substrate for catalysis, and various combinations of active site mutations at both sides may be needed to convert an ADH to a fully functional PDH.

Figure 10C:
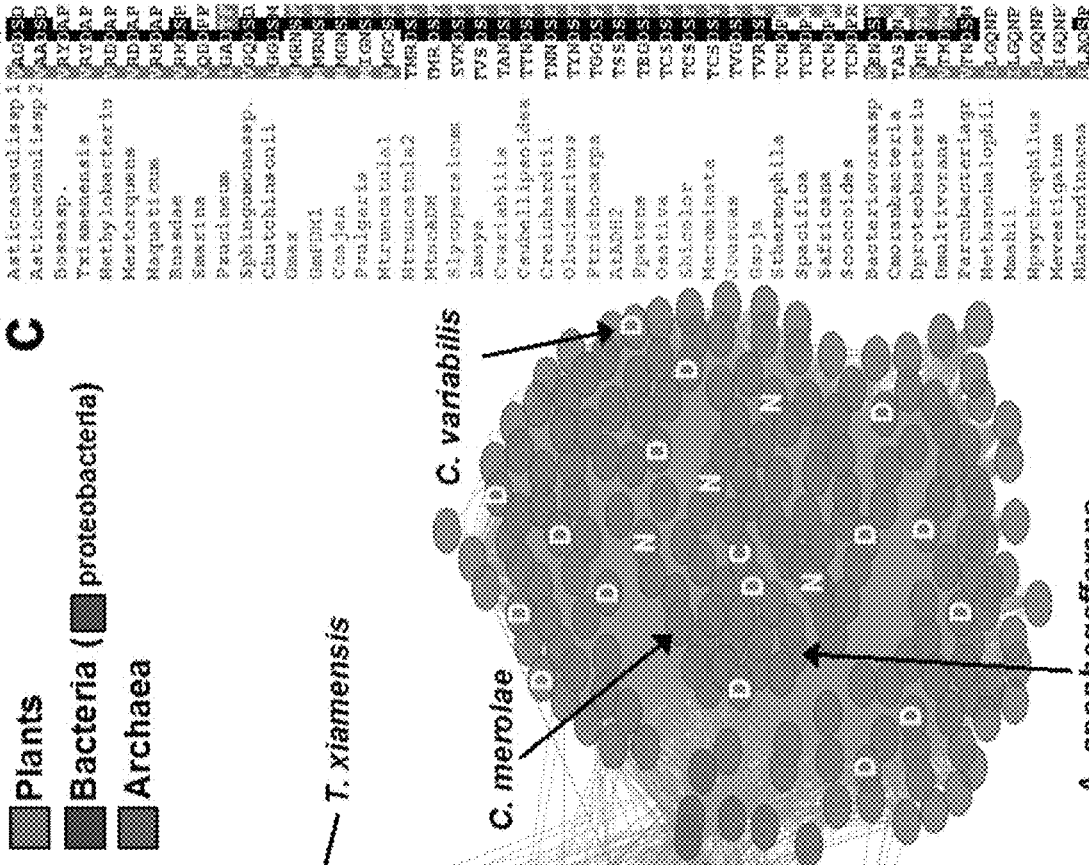
Figure 10B:
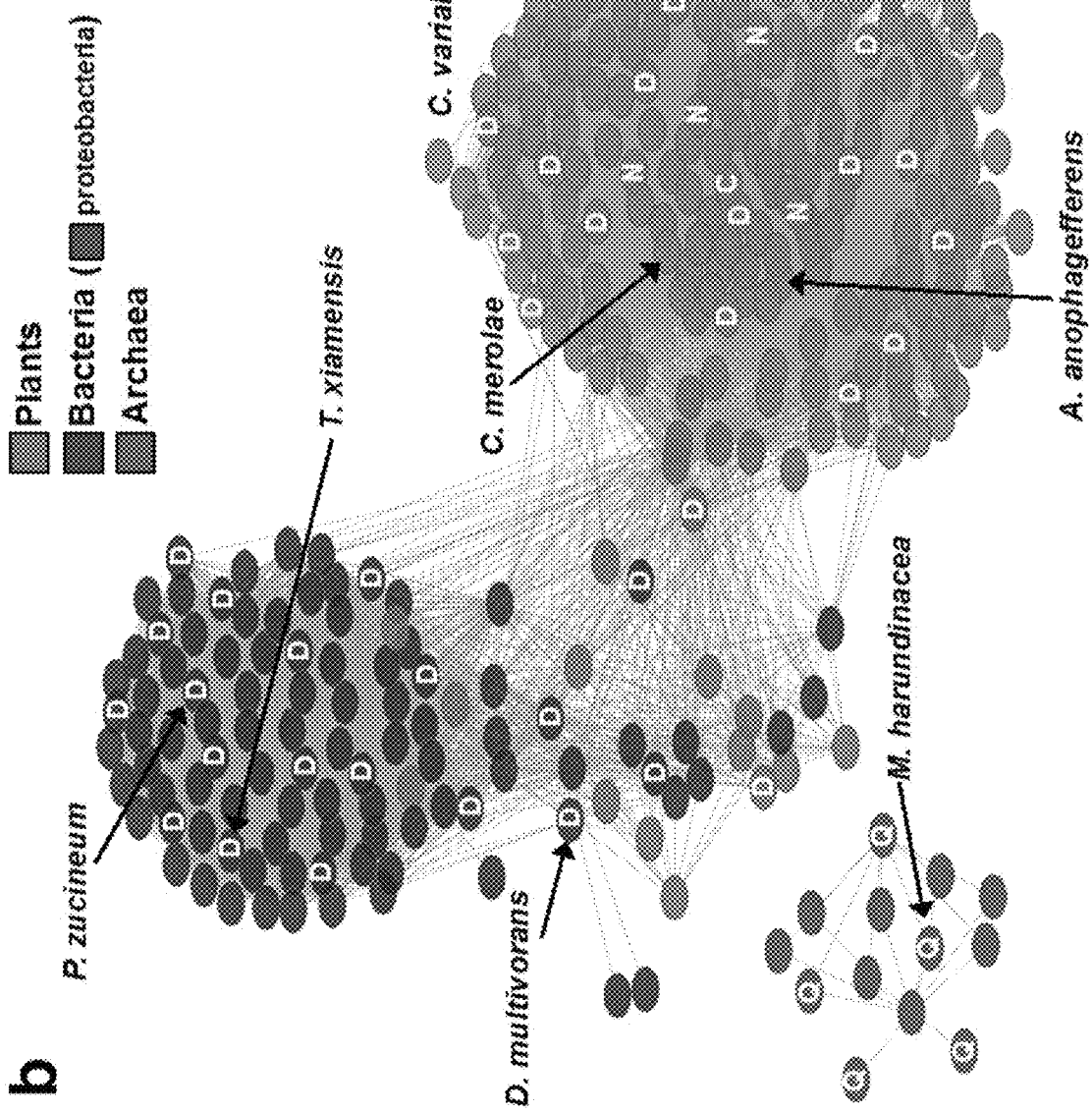

The residue corresponding to Asp218 that confers ADH activity can now be used to trace the evolutionary origin of the plant ADHs. Asp218 is present in TyrA homologs of all plants and algae, including green, red, and brown algae (FIG. 10), suggesting that Asp218-containing ADH enzymes are universal to the plant kingdom. Previous and current analyses showed that plant ADHs are more closely related to proteobacteria and methanogens (archaea) than cyanobacteria[16,21,43] (FIG. 10B, Table 4). Interestingly, an Asp residue was present at the corresponding 218 position in the TyrA orthologs of proteobacteria, which was previously shown to have ADH activity (e.g. *Phenylobacterium immoble*[26]), but absent in those of archaea (FIGS. 10B, 10C). Together these data suggest that ADH enzymes containing Asp218 evolved in a bacteria ancestor, which was horizontally transferred to the common ancestor of plants and algae. Together with PPA-ATs acquired from a Chlorobi/Bacteroidetes ancestor, the Asp218-containing ADHs are maintained in the plant kingdom to synthesis Tyr via the arogenate pathway.

TABLE 4

Amino acid sequence similarity comparison for representative plant and microbial TyrA homologs.

| | GmPDH1 | GmncADH | AtADH2 | D. multivorans | T. xiamensis | M. harundinacea | Synechocystis ADH | A. aeolicus PDH | S. cerevisiae PDH |
|---|---|---|---|---|---|---|---|---|---|
| GmPDH1 | 100 | | | | | | | | |
| GmncADH | 90.0 | 100 | | | | | | | |
| AtADH2 | 68.75 | 69.37 | 100 | | | | | | |
| D. multivorans | 62.08 | 63.54 | 54.37 | 100 | | | | | |
| T. xiamensis | 61.87 | 61.87 | 55.0 | 66.45 | 100 | | | | |
| M. harundinacea | 53.75 | 53.33 | 52.7 | 53.29 | 55.41 | 100 | | | |
| Synechocystis ADH | 52.33 | 53.0 | 47.19 | 56.04 | 53.16 | 47.08 | 100 | | |

TABLE 4-continued

Amino acid sequence similarity comparison for representative plant and microbial TyrA homologs.

| | GmPDH1 | GmncADH | AtADH2 | D. multivorans | T. xiamensis | M. harundinacea | Synechocystis ADH | A. aeolicus PDH | S. cerevisiae PDH |
|---|---|---|---|---|---|---|---|---|---|
| A. aeolicus PDH | 47.5 | 48.54 | 42.91 | 47.91 | 48.75 | 42.5 | 56.25 | 100 | |
| S. cerevisiae PDH | 21.66 | 20.83 | 21.66 | 18.54 | 22.08 | 25.41 | 17.7 | 12.7 | 100 |

Sequence similarity is based on the network shown in FIG. 10. S. cerevisiae PDH was included because it was found to be sister to plants in some phylogenetic analyses[16,30]; however, due to lack of sequence similarity it was not present in our sequence similarity network or other phylogenetic analyses of plant TyrA homologs[21,43]. Plant TyrA homologs share greater sequence similarity with proteobacterial TyrA homologs than archaea, cyanobacteria, yeast, or other bacteria.

Is the corresponding Asp residue also responsible for substrate specificity and regulation of divergent microbial TyrA dehydrogenases? To address this question, the three-dimensional structure of GmPDH1 (FIG. 2), the first of a plant TyrA structure, was compared to previously reported microbial TyrAs from the cyanobacteria *Synechocystis* sp. PCC 6803 (SynADH; PDB: 2F1K;[29]) and *A. aeolicus* PDH (AaPDH; PDB: 3GGG;[34]). SynADH is specific to arogenate substrate and Tyr insensitive, whereas AaPDH prefers prephenate and is sensitive to Tyr[29,34]. The overall fold of GmPDH1 is conserved (root mean square deviations of 2.5-3.0 Å$^2$ for ~235 Cα atoms) with SynADH and AaPDH (FIG. 11A). While the N-terminal Rossmann-fold was highly conserved, some differences in topology were found in the C-terminal dimerization domain: the $3_{10}$ helix (α9) and the long C-terminal helix (α13) of SynADH and AaPDH are missing in the soybean enzyme, and the α7 helix of GmPDH1 is split into two helices in SynADH and AaPDH (α7 and α8) (FIG. 11A).

Comparison of cofactor binding sites reveals a structural variation near the adenine ribose, which defines NADP(H) cofactor specificity of GmPDH1. An elongated β1b-α2 loop in GmPDH1 (Ser39-Tyr43) and also NADP(H)-dependent SynADH (Ser30-Thr35) forms charge-charge and hydrogen bond contacts with the phosphate group of NADP(H). In contrast, the shorter loop of NAD(H)-dependent AaPDH (Asp62-Ile63) fills the corresponding space and allows for direct interaction with the hydroxyl groups of the adenine ribose of NAD(H) (FIG. 11). Interestingly, the diphosphate group of NADP(H) adopts a trans-conformation in GmPDH1, where the same cofactor moiety in SynADH and AaPDH are in cis-conformations (FIG. 11B). In SyADH and AaPDH, a 4.5 and 7.7 Å shift in α1 compared to GmPDH, respectively, containing part of the GxGxxG motif, accommodates the cis conformer of cofactor. Thus, the trans-conformation of cofactor appear to be a unique feature of GmPDH1 and likely plant TyrAs.

Despite the cofactor binding site variations, each structure maintains the positioning of the ribose and nicotinamide ring relative to a key catalytic histidine (FIGS. 4B, 4C; FIGS. 11B, 11C). The residues that contribute hydrogen bonds to the nicotinamide ribose (Thr73 and Ser101 in GmPDH1; Thr65 and Ser92 in SynADH; Ser99 and Ser126 in AaPDH) are conserved, as is an apolar residue stacking with the nicotinamide ring (Phe28 in GmPDH1; Ile11 in SynADH; Met41 in AaADH) (FIGS. 4B, 4C; FIGS. 11B, 11C). Overall, these interactions position the C4 of the nicotinamide ring in proximity to the conserved catalytic histidine (His124 in GmPDH1; His112 in SynADH; His147 in AaPDH) for the ensuing oxidative decarboxylation reaction[29,33,34].

Notable differences were found in the architecture of the residues and regions that recognize the side chain of substrates and the Tyr effector (FIG. 11C); part of which reflects the structural variations in the dimerization domain (FIG. 11A). SynADH contains an Asn in the 222 position similar to GmPDH1, while AaPDH has Asp255 at the corresponding position. However, the placement of α-helix adjacent to Asn222 or Asp255 (all in SynADH and AaPDH compared to α9 in GmPDH1) varies. This is likely due to a proline residue uniquely present in SynADH and AaPDH but absent in GmPDH1, which kinks the all helix to orient the ligand towards the catalytic His. Moreover, the 131e-131f loop, which is opposite from Asn222 or Asp255, is condensed in GmPDH1 (Phe127-Trp136) compared to SynADH (Ala115-Leu129) and AaPDH (Ala150-Leu164). These key differences in the active site configuration likely prevent the Asp/Asn residue from being involved in arogenate/prephenate specificity and Tyr inhibition in the microbial structures (FIG. 11C). Thus, microbial TyrA dehydrogenases, which are distantly-related from plant TyrAs (Table 4), have taken different and yet unknown evolutionary pathway towards refining substrate specificity as compared to plant TyrAs.

In summary, using a combined phylogenic and structural approach, we identified the critical residue that controls the substrate specificity and Tyr sensitivity of TyrAs and underlies the functional evolution of alternative Tyr pathways in plants. The high conservation of the Asp residue among all plantae and some microbial TyrA orthologs suggests an ancient evolutionary origin of the ADH Tyr pathway universally present in the plant kingdom today. The identified key residue can now be used to alter Tyr biosynthetic pathways and regulation, as demonstrated in diverse plant TyrAs (FIG. 5), to optimize Tyr availability for the production of its derived natural products, including vitamin E and morphine alkaloid.

Generation of Transgenic Plants

The ADH and PDH polynucleotides, constructs and vectors described herein may be used to generate transgenic plants comprising the ADH and PDH polynucleotides. The ADH and PDH polynucleotides will be operably connected to a promoter functional in the plant cells. The resulting construct will be introduced into the plant cells via a method of transformation or other introduction of genetic material into plant cells. One optional method is insertion via *Agrobacterium tumefaciens* insertion of the DNA into the flowering plants. The polynucleotide can then be selected for either directly by testing for expression of the inserted polynucleotide or alternatively the construct may include a selectable marker to make selection of transgenic plants simple.

Materials and Methods

Identification of ncADH Enzymes from Plants

BlastP® alignment tool searches were performed using the amino acid sequence of GmPDH1/Gm18g02650 (KM507071) and MtPDH/Mt3g071980 (KM507076) as queries against various plant lineages found within the Phytozome (phytozome.net) and 1KP (onekp.com) databases. A phylogenetic analysis was performed using all the homologs identified through BlastP® alignment tool searches. Evolutionary distances were estimated based on maximum likelihood[44]. Phylogenetic analysis was performed in MEGA6[45] from an amino acid alignment using MUSCLE[46]. All positions with <75% site coverage were removed, leaving 263 positions in the final analysis from 32 sequences, the tree was estimated with 1,000 bootstrap replicates (FIG. 1B).

Recombinant Protein Expression and Purification and Site Directed Mutagenesis

Full-length coding sequences of GmPDH1, GmncADH, MtPDH, MtncADH were amplified using gene-specific primers with Phusion DNA polymerase (Thermo). The PCR products were purified using QIAquick gel extraction kit (Qiagen) and ligated into pET28a vector (Novagen) at EcoRI and NdeI sites, in frame with an N-terminal 6×-His tag using In-Fusion HD cloning kit and protocol (Clontech). A PCR reaction consisting of 1 U Phusion DNA polymerase (Thermo) with 0.2 mM dNTP's, 0.5 µM forward and reverse primers (Table 5) and 1× Phusion reaction buffer (Thermo) were mixed with plasmid template diluted 100-fold. The mixture was placed in a thermocyler for 98° C. for 30 s followed by 20 cycles of 10 s at 98° C., 20 s at 70° C., 4.5 min at 72° C. with a final extension at 72° C. for 10 min. PCR products were purified using a QIAquick Gel Exraction Kit, then treated with DpnI (Thermo) to digest methylated template DNA for 30 min at 37° C. Plasmids encoding either wild-type or site-directed GmPDH1 were transformed into *E. coli* XL1-Blue cells, and sequenced to confirm the correct mutation was made.

TABLE 5

Primers used in this Example

| Name | Use | sequence (5'-3') |
|---|---|---|
| GmPDHM219TF | mutagenesis | GGAGACGACGATGAGAAATAGTTTTGATTTGTATAG (SEQ ID NO: 97) |
| GmPDHM219TR | mutagenesis | CAAAACTATTTCTCATCGTCGTCTCCTTCAATTTAAC (SEQ ID NO: 98) |
| GmPDHN222DF | mutagenesis | GGAGACGATGATGAGAGATAGTTTTGATTTGTATAG (SEQ ID NO: 99) |
| GmPDHN222DR | mutagenesis | CAAAACTATCTCTCATCATCGTCTCCTTCAATTTAAC (SEQ ID NO: 100) |
| GmPDHN222AF | mutagenesis | GGAGACGATGATGAGAGCTAGTTTTGATTTGTATAG (SEQ ID NO: 101) |
| GmPDHN222AR | mutagenesis | CAAAACTAGCTCTCATCATCGTCTCCTTCAATTTAAC (SEQ ID NO: 102) |
| GmPDHM219TN222DF | mutagenesis | GGAGACGACGATGAGAGATAGTTTTGATTTGTATAG (SEQ ID NO: 103) |
| GmPDHM219TN222DR | mutagenesis | CAAAACTATCTCTCATCGTCGTCTCCTTCAATTTAAC (SEQ ID NO: 104) |
| GmncADHD218NF | mutagenesis | AGGACACCACCATCAGAAATAGTTTTGACTTGTACA (SEQ ID NO: 105) |
| GmncADHD218NR | mutagenesis | AAAACTATTTCTGATGGTGGTGTCCTTCAATTGAA (SEQ ID NO: 106) |
| MtPDHC220DF | mutagenesis | GTCATGGGTGATAGTTTTGATCTGTATAGTGGATTATTCG (SEQ ID NO: 107) |
| MtPDHC220DR | mutagenesis | GATCAAAACTATCACCCATGACAGGTTTTTTCAACTCAAC (SEQ ID NO: 108) |
| MtncADHF | cloning | CGCGCGGCAGCCATATGTCAAATTCACCTTCTCTG (SEQ ID NO: 109) |
| MtncADHR | cloning | GACGGAGCTCGAATTCATGCATCAACATTCAGTCTT (SEQ ID NO: 110) |
| MtncADHD220CF | mutagenesis | CCATGAGATGTAGTTTTGATCTGTACAGTGGATTGTTTG (SEQ ID NO: 111) |
| MtncADHD220C | mutagenesis | CAAAACTACATCTCATGGTGGTGTTCTTCAGTTGAGTAAG (SEQ ID NO: 112) |
| Peanut PDH/ADHF | cloning | CGCGCGGCAGCCATATGTCATCTTCCCATTCCCAAAA (SEQ ID NO: 113) |
| Peanut PDH/ADHR | cloning | GACGGAGCTCGAATTCTCAACTTTCAGTTTTTTCTT (SEQ ID NO: 114) |

TABLE 5-continued

Primers used in this Example

| Name | Use | sequence (5'-3') |
|---|---|---|
| SolyncADHF | cloning | CGCGCGGCAGCCATATGATGTCTTCATCTTCTTCTTG (SEQ ID NO: 115) |
| SolyncADHR | cloning | GACGGAGCTCGAATTCTTAGAACTTTGATATGATAGG (SEQ ID NO: 116) |
| SolyncADHD224NF | mutagenesis | GCTCAGTTAAAAATAGTTTTGATCTGTTCAGCGG (SEQ ID NO: 117) |
| SolyncADHD224NR | mutagenesis | GATCAAAACTATTTTTAACTGAGCTCTCCTTCAC (SEQ ID NO: 118) |
| AtADH2D241NF | mutagenesis | CACATCGAGTAATAGCTTTGAGCTTTTCTACGG (SEQ ID NO: 119) |
| AtADH2D241NR | mutagenesis | CTCAAAGCTATTACTCGATGTGTTCTCCACCAAATC (SEQ ID NO: 120) |

Confirmed plasmids were then transformed into *E. coli* Rosetta-2 (DE3) cells (Novagen) by heat shock at 42° C. for 60 s. For recombinant protein expression, overnight cultures in 10 mL Luria broth (LB) supplemented with 100 µg/mL kanamycin were grown at 37° C. with 200 r.p.m. shaking. The following morning 1 mL of culture was added into 50 mL of fresh LB without antibiotics and allowed to grow at 37° C. with 200 r.p.m. shaking. After 1 hour, 10 mL was added into 500 mL of fresh LB with kanamycin (100 µg/mL) and grown until the $OD_{600}$ reached 0.3, and the incubator was changed to 18° C. After 1 hour isopropyl β-D-1-thiogalactopyranoside (IPTG, 0.4 mM final concentration) was added to induce recombinant protein expression and grown for an additional 20 hours. Cultures were spun at 10,000×g for 10 minutes, and the supernatant was decanted. The pellet was resuspended in 100 mL of 0.9 M NaCl, and spun for 10 minutes at 10,000×g. The supernatant was decanted and the remaining pellet was redissolved in 25 mL lysis buffer (25 mM HEPES pH 7.6, 50 mM NaCl, 10% (v/v) ethylene glycol) plus 0.5 mM phenylmethylsulfonyl fluoride. Cells were frozen in liquid N2, and thawed in hot water to initiate cell lysis, 25 mg of lysozyme (Dot Scientific) was added and cells sonicated for 3 min. Cell debris was pelleted by centrifugation (30 min; 50,000×g). Supernatant was applied to a 1 mL HisTrap FF column for purification of the His-tagged recombinant protein using an ÄKTA FPLC system (GE Healthcare Bio-Sciences). After loading protein the column was washed with 90% buffer A (0.5 M NaCl, 0.2 M NaP and 20 mM imidazole) and 10% buffer B (0.5 M NaCl, 0.2 M NaP and 0.5 M imidazole, recombinant enzyme was then eluted with 100% buffer B. Fractions containing purified protein were pooled and desalted by Sephadex G50 column (GE Healthcare) size-exclusion chromatography into lysis buffer. The purified proteins were analyzed by SDS-PAGE to determine purity. All protein purification steps were performed at 4° C. unless stated otherwise.
GmPDH1 Crystallization Purified protein (see above) was loaded onto a Superdex-75 26/60 HiLoad FPLC size-exclusion column (GE Healthcare) equilibrated with 25 mM Hepes, pH 7.5, and 100 mM NaCl. Protein concentration was determined by the Bradford method (Protein Assay, Bio-Rad) with bovine serum albumin as a standard. For selenium-methionine (SeMet) GmPDH1 expression, *E. coli* Rosetta II (DE3) cells containing the PDH construct were grown to an $OD_{600}$~0.6 in M9 minimal media, at which point the media was supplemented with 60 mg SeMet, valine, leucine, and isoleucine and 100 mg of lysine, phenylalanine, and threonine and induced with 1 mM IPTG for 16-18 hours at 16° C. SeMet GmPDH1 was purified as described for native GmPDH1.

Purified enzyme was concentrated to 10 mg ml$^{-1}$ and crystallized using the hanging-drop vapor-diffusion method with a 2-µl drop (1:1 protein and crystallization buffer). Tyr (3 mM final) was added to both GmPDH1 M219T/N222D and GmPDH1 N222D. Diffraction quality crystals of the native GmPDH1 were obtained at 4° C. with a crystallization buffer of 20% PEG-4000, 30% (w/v) D-sorbitol, and 100 mM sodium citrate, pH 5.5. Crystals of SeMet PDH1 formed at 4° C. with a crystallization buffer of 20% (w/v) PEG-3350, 100 mM sodium citrate, pH 4.0, and 200 mM sodium citrate tribasic. Crystals of GmPDH1 N222D formed in 2 mM of an oxometalates solution containing 0.005 M sodium chromate tetrahydrate, 0.005 M sodium molybdate dihydrate, 0.005 M sodium tungstate dihydrate, and 0.005 M sodium orthovanadate, 0.1 M of MOPSO and bis-Tris, pH 6.5, and 50% (v/v) of a precipitant mixture of 20% (w/v) PEG-8000 and 40% (v/v) 1,5-pentanediol[47]. Crystals of GmPDH1 M219T/N222D formed in 16% (w/v) PEG 8000, 40 mM potassium phosphate dibasic, and 20% (v/v) glycerol. All crystals were flash-frozen in liquid nitrogen with mother liquor supplemented with 25% glycerol as a cryoprotectant.

The GmPDH1 structure was solved by single-wavelength anomalous dispersion (SAD) phasing. Diffraction data collected at beamline 19ID of the Argonne National Laboratory Advanced Photon Source were indexed, integrated, and scaled using HKL3000[48]. SHELX[49] was used to determine initial SeMet positions and to estimate initial phases from the peak wavelength data set. SeMet positions and parameters were refined in MLPHARE[50]. Solvent flattening was performed with DM[51], and ARP/wARP[52] was used to build an initial model. Iterative rounds of manual model building and refinement were performed with COOT[53] and PHENIX[54], respectively. The resulting model was used for molecular replacement into the higher resolution native data set using PHASER[55]. Iterative rounds of manual model building and refinement, which included translation-libration-screen (TLS) models, used COOT and PHENIX, respectively. The native GmPDH1 structure was used for molecular replacement to solve the GmPDH1 N222D and GmPDH1 M219T/N222D structures. Each mutant structure was built and refined using the same method as the wild-type enzyme. Data collection and refinement data are summarized in Table 2. The final model of SeMet-substituted GmPDH1 included residues Ser9 to Gln258 and NADP$^+$ for both molecules in the asymmetric unit and 228 waters. The final model of the GmPDH1•NADP$^+$•citrate complex included residues Gln8 to Ile257 for chain A and residues Gln8 to Thr260 for chain B, NADP$^+$ and citrate in both chains, and 605 waters. The structure was intended to be an apoenzyme, but NADP$^+$ and citrate were bound in the active site. The final model of the GmPDH1 N222D•NADP$^+$•Tyr complex included residues Ser9 to Met258 for chain A and residues Gln8 to Thr260 for chain B, NADP$^+$ and Tyr in both chains, and 435 waters. The final model of the GmPDH1 M219T/N222D•NADP$^+$•Tyr complex included residues Ser9 to Ile257 for chain A and residues Gln8 to Ile257 for chain B, NADP$^+$ and Tyr in both chains, and 616 waters.

ADH and PDH Assay

Kinetic parameters of purified recombinant proteins were determined from assays conducted at varying arogenate (19.5 µM-5 mM) and prephenate concentration (23.4 µM-6 mM). Standard assay conditions were 25 mM HEPES pH 7.6, 50 mM KCl and 10% (v/v) ethylene glycol, and 0.5 mM NADP$^+$ with varied substrate, concentrations. Reactions were initiated by addition of enzyme and incubated at 37° C. monitored every 10-15 seconds at $A_{340nm}$ using a microplate reader (Tecan Genios). Kinetic parameters were determined by fitting initial velocity data to the Michaelis-Menten equation using the Origin software (OriginLab). Arogenate was prepared by enzymatic conversion of prephenate (Sigma-Aldrich) as previously reported[56]. For Tyr inhibition assays, Tyr was dissolved in a slightly basic solution (0.025 N NaOH) due to solubility issues, thus the concentration of lysis buffer was increased to 500 mM HEPES final concentration to buffer against the changes by addition of Tyr in the reaction. Reactions containing varying amounts of Tyr (10 µM-8 mM) with 0.5 mM NADP$^+$ and either 1 mM arogenate or 0.8 mM prephenate were monitored as above.

Computational Substrate Docking

Molecular docking of prephenate and arogenate into the GmPDH1 M219T/N222D•NADP$^+$•Tyr three-dimensional model with Tyr removed was performed using AutoDock Vina (ver. 1.1.2)[57]. The positions of NADP$^+$ and Tyr in the structure was used to guide docking with a grid box of 30×30×30 Å and the level of exhaustiveness set to 8.

REFERENCES FOR EXAMPLE 1

1. Weng, J.-K., Philippe, R. N. & Noel, J. P. The Rise of Chemodiversity in Plants. *Science* 336, 1667-1670 (2012).
2. Gowik, U. & Westhoff, P. The Path from C3 to C4 Photosynthesis. *Plant Physiol.* 155, 56-63 (2011).
3. Torruella, G., Suga, H., Riutort, M., Peretó, J. & Ruiz-Trillo, I. The evolutionary history of lysine biosynthesis pathways within eukaryotes. *J. Mol. Evol.* 69, 240-248 (2009).
4. Jensen, R. A. & Pierson, D. L. Evolutionary implications of different types of microbial enzymology for L-tyrosine biosynthesis. *Nature* 254, 667-671 (1975).
5. Schenck, C. A., Chen, S., Siehl, D. L. & Maeda, H. A. Non-plastidic, tyrosine-insensitive prephenate dehydrogenases from legumes. *Nat. Chem. Biol.* 11, 52-57 (2015).
6. Maeda, H. & Dudareva, N. The shikimate pathway and aromatic amino acid biosynthesis in plants. *Annu. Rev. Plant Biol.* 63, 73-105 (2012).
7. Tzin, V. & Galili, G. New insights into the shikimate and aromatic amino acids biosynthesis pathways in plants. *Mol. Plant* 3, 956-72 (2010).
8. Fernstrom, J. D. & Fernstrom, M. H. Tyrosine, phenylalanine, and catecholamine synthesis and function in the brain. *J. Nutr.* 137, 1539S-1547S; discussion 1548S (2007).
9. Hagel, J. M. & Facchini, P. J. Benzylisoquinoline alkaloid metabolism: a century of discovery and a brave new world. *Plant Cell Physiol.* 54, 647-672 (2013).
10. Petersen, M. et al. Evolution of rosmarinic acid biosynthesis. *Phytochemistry* 70, 1663-1679 (2009).
11. Gleadow, R. M. & Møller, B. L. Cyanogenic glycosides: synthesis, physiology, and phenotypic plasticity. *Annu. Rev. Plant Biol.* 65, 155-185 (2014).
12. Strack, D., Vogt, T. & Schliemann, W. Recent advances in betalain research. *Phytochemistry* 62, 247-69 (2003).
13. Hunter, S. C. & Cahoon, E. B. Enhancing vitamin E in oilseeds: unraveling tocopherol and tocotrienol biosynthesis. *Lipids* 42, 97-108 (2007).
14. Millner, P. a. & Barber, J. Plastoquinone as a mobile redox carrier in the photosynthetic membrane. *FEBS Lett.* 169, 1-6 (1984).
15. Barros, J. et al. Role of bifunctional ammonia-lyase in grass cell wall biosynthesis. *Nat. Plants* 2, 16050 (2016).
16. Bonner, C. a et al. Cohesion group approach for evolutionary analysis of TyrA, a protein family with wide-ranging substrate specificities. Microbiol. *Mol. Biol. Rev. MMBR* 72, 13-53 (2008).
17. Hudson, G., Wong, V. & Davidson, B. Chorismate mutase/prephenate dehydrogenase from *Escherichia coli* K12: purification, characterization, and identification of a reactive cysteine. *Biochemistry (Mosc.)* 23, 6240-6249 (1984).
18. Fischer, R. S. & Jensen, R. A. Prephenate dehydrogenase (monofunctional). *Methods Enzymol.* 142, 503-507 (1987).
19. Rippert, P. & Matringe, M. Purification and kinetic analysis of the two recombinant arogenate dehydrogenase isoforms of *Arabidopsis thaliana*. *Eur. J. Biochem.* 269, 4753-4761 (2002).
20. Dal Cin, V. et al. Identification of genes in the phenylalanine metabolic pathway by ectopic expression of a MYB transcription factor in tomato fruit. *Plant Cell* 23, 2738-53 (2011).
21. Dornfeld, C. et al. Phylobiochemical characterization of class-ib aspartate/prephenate aminotransferases reveals evolution of the plant arogenate phenylalanine pathway. *Plant Cell* 26, 3101-14 (2014).
22. Maeda, H., Yoo, H. & Dudareva, N. Prephenate aminotransferase directs plant phenylalanine biosynthesis via arogenate. *Nat. Chem. Biol.* 7, 19-22 (2011).
23. Gaines, C. G., Byng, G. S., Whitaker, R. J. & Jensen, R. A. L-Tyrosine regulation and biosynthesis via arogenate dehydrogenase in suspension-cultured cells of *Nicotiana silvestris* Speg. et Comes. *Planta* 156, 233-240 (1982).
24. Connelly, J. A. & Conn, E. E. Tyrosine biosynthesis in *Sorghum bicolor*: isolation and regulatory properties of arogenate dehydrogenase. *Z. Naturforschung C J. Biosci.* 41, 69-78 (1986).
25. Keller, B., Keller, E. & Lingens, F. Arogenate dehydrogenase from *Streptomyces phaeochromogenes*-purification and properties. *Biol. Chem. Hoppe. Seyler* 366, 1063-1066 (1985).

26. Mayer, E., Waldner-Sander, S., Keller, B., Keller, E. & Lingens, F. Purification of arogenate dehydrogenase from *Phenylobacterium immobile*. *FEBS Lett.* 179, 208-212 (1985).
27. Rubin, J. L. & Jensen, R. A. Enzymology of L-tyrosine biosynthesis in mung bean (*Vigna radiata* [L.] *Wilczek*). *Plant Physiol.* 64, 727-734 (1979).
28. Gamborg, O. L. & Keeley, F. W. Aromatic Metabolism in Plants I. A study of the Prephenate Dehydrogenase from Bean Plants. *Biochim. Biophys. Acta* 115, 65-72 (1966).
29. Legrand, P. et al. Biochemical characterization and crystal structure of Synechocystis arogenate dehydrogenase provide insights into catalytic reaction. *Structure* 14, 767-776 (2006).
30. Song, J., Bonner, C. a, Wolinsky, M. & Jensen, R. a. The TyrA family of aromatic-pathway dehydrogenases in phylogenetic context. *BMC Biol.* 3, 13 (2005).
31. Christendat, D., Saridakis, V. & Turnbull, J. Use of site-directed mutagenesis to identify residues specific for each reaction catalyzed by chorismate mutase-prephenate dehydrogenase from *Escherichia coli. Biochemistry (Mosc.)* 37, 1573-1580 (1998).
32. Christendat, D. & Turnbull, J. L. Identifying groups involved in the binding of prephenate to prephenate dehydrogenase from *Escherichia coli. Biochemistry (Mosc.)* 38, 4782-4793 (1999).
33. Sun, W., Singh, S., Zhang, R., Turnbull, J. L. & Christendat, D. Crystal structure of prephenate dehydrogenase from *Aquifex aeolicus*: insights into the catalytic mechanism. *J. Biol. Chem.* 281, 12919-12928 (2006).
34. Sun, W. et al. The crystal structure of *Aquifex aeolicus* prephenate dehydrogenase reveals the mode of tyrosine inhibition. *J. Biol. Chem.* 284, 13223-13232 (2009).
35. Lütke-eversloh, T. & Stephanopoulos, G. Feedback inhibition of chorismate mutase/prephenate dehydrogenase (TyrA) of *Escherichia coli*: generation and characterization of tyrosine-insensitive mutants. *Appl. Environ. Microbiol.* 71,7224-7228 (2005).
36. Wierenga, R. K., De Maeyer, M. C. H. & Hol, W. G. J. Interaction of pyrophosphate moieties with alpha-helices in dinucleotide-binding proteins. *Biochemistry (Mosc.)* 24, 1346-1357 (1985).
37. Rippert, P., Puyaubert, J., Grisollet, D., Derrier, L. & Matringe, M. Tyrosine and phenylalanine are synthesized within the plastids in Arabidopsis. *Plant Physiol.* 149, 1251-60 (2009).
38. Jung, E., Zamir, L. O. & Jensen, R. A. Chloroplasts of higher plants synthesize L-phenylalanine via L-arogenate. *Proc. Natl. Acad. Sci. U.S.A* 83, 7231-7235 (1986).
39. Wang, M., Toda, K. & Maeda, H. A. Biochemical properties and subcellular localization of tyrosine aminotransferases in *Arabidopsis thaliana. Phytochemistry* 132, 16-25 (2016).
40. Westfall, C. S., Xu, A. & Jez, J. M. Structural evolution of differential amino acid effector regulation in plant chorismate mutases. *J. Biol. Chem.* 289, 28619-28 (2014).
41. Cardoso, D. et al. Revisiting the phylogeny of papilionoid legumes: New insights from comprehensively sampled early-branching lineages. *Am. J. Bot.* 99, 1991-2013 (2012).
42. Wojciechowski, M. F., Lavin, M. & Sanderson, M. J. A phylogeny of legumes (Leguminosae) based on analysis of the plastid matK gene resolves many well-supported subclades within the family. *Am. J. Bot.* 91, 1846-62 (2004).
43. Reyes-Prieto, A. & Moustafa, A. Plastid-localized amino acid biosynthetic pathways of Plantae are predominantly composed of non-cyanobacterial enzymes. *Sci. Rep.* 2, 955 (2012).
44. Whelan, S. & Goldman, N. A general empirical model of protein evolution derived from multiple protein families using a maximum-likelihood approach. *Mol. Biol. Evol.* 18, 691-9 (2001).
45. Tamura, K., Stecher, G., Peterson, D., Filipski, A. & Kumar, S. MEGA6: Molecular Evolutionary Genetics Analysis Version 6.0. *Mol. Biol. Evol.* 30, 2725-2729 (2013).
46. Edgar, R. C. MUSCLE: multiple sequence alignment with high accuracy and high throughput. *Nucleic Acids Res.* 32, 1792-1797 (2004).
47. Gorrec, F. The current approach to initial crystallization screening of proteins is under-sampled. *J. Appl. Crystallogr.* 46, 795-797 (2013).
48. Minor, W., Cymborowski, M., Otwinowski, Z. & Chruszcz, M. HKL-3000: the integration of data reduction and structure solution—from diffraction images to an initial model in minutes. *Acta Crystallogr. D Biol. Crystallogr.* 62, 859-866 (2006).
49. Sheldrick, G. M. A short history of SHELX. *Acta Crystallogr. A* 64, 112-122 (2008).
50. Collaborative Computational Project, Number 4. The CCP4 suite: programs for protein crystallography. *Acta Crystallogr. D Biol. Crystallogr.* 50, 760-763 (1994).
51. Terwilliger, T. C. Maximum-likelihood density modification. *Acta Crystallogr. D Biol. Crystallogr.* 56, 965-972 (2000).
52. Morris, R. J., Perrakis, A. & Lamzin, V. S. ARP/wARP and automatic interpretation of protein electron density maps. *Methods Enzymol.* 374, 229-244 (2003).
53. Emsley, P. & Cowtan, K. Coot: model-building tools for molecular graphics. *Acta Crystallogr. D Biol. Crystallogr.* 60, 2126-2132 (2004).
54. Adams, P. D. et al. PHENIX: a comprehensive Python-based system for macromolecular structure solution. *Acta Crystallogr. D Biol. Crystallogr.* 66, 213-221 (2010).
55. McCoy, A. J. et al. Phaser crystallographic software. *J. Appl. Crystallogr.* 40, 658-674 (2007).
56. Maeda, H. et al. RNAi suppression of arogenate dehydratase1 reveals that phenylalanine is synthesized predominantly via the arogenate pathway in petunia petals. *Plant Cell* 22, 832-49 (2010).
57. Trott, O. & Olson, A. J. AutoDock Vina: improving the speed and accuracy of docking with a new scoring function, efficient optimization, and multithreading. *J. Comput. Chem.* 31, 455-461 (2010).
58. Atkinson, H. J., Morris, J. H., Ferrin, T. E. & Babbitt, P. C. Using sequence similarity networks for visualization of relationships across diverse protein superfamilies. *PloS One* 4, e4345 (2009).
59. Shannon, P. et al. Cytoscape: a software environment for integrated models of biomolecular interaction networks. *Genome Res.* 13, 2498-2504 (2003).
60. Bonner, C. A., Fischer, R. S., Schmidt, R. R., Miller, P. W. & Jensen, R. A. Distinctive enzymes of aromatic amino acid biosynthesis that are highly conserved in land plants are also present in the chlorophyte alga *Chlorella sorokiniana. Plant Cell Physiol.* 36, 1013-1022 (1995).

Example 2—Conserved Molecular Mechanism of TyrA Dehydrogenase Substrate Specificity Underlying Alternative Tyrosine Biosynthetic Pathways in Plants and Microbes In this Example, structure-guided phylogenetic analyses identified bacterial homologs, closely-related to plant TyrAs, that also have an acidic 222 residue and ADH activity. A more distant archaeon TyrA that preferred PDH activity had a non-acidic Gln, whose substitution to Glu introduced ADH activity. Thus, the conserved molecular mechanism was involved in the evolution of arogenate-specific TyrAa in both plants and microbes.

This Example is based on data reported in Schenck et al., "Conserved Molecular Mechanism of TyrA Dehydrogenase Substrate Specificity Underlying Alternative Tyrosine Biosynthetic Pathways in Plants and Microbes," *Front Mol Biosci* 4:73 (2017), the contents of which (including all supplemental data, figures, and associated materials) is incorporated herein by reference.

Materials and Methods
Identification of Microbial TyrA Orthologs

BlastP® alignment tool searches were performed using the amino acid sequences of previously characterized TyrA homologs from plants (soybean PDH; GmPDH1 (Schenck et al., 2015) and Arabidopsis ADH; AtADH2; Rippert and Matringe, 2002) and microbes (*Synechocystis* sp. PCC6803 ADH (Legrand et al., 2006), and *E. coli* PDH (Hudson et al., 1984)) as the query in the NCBI database. This yielded only closely-related plant and microbial TyrA orthologs (e.g. algae and, γ-proteobacteria), which were then used as the query to perform additional BlastP® alignment tool searches. Every 5th BlastP® alignment tool hit was selected to provide sequences from various microbial lineages and limit bias in sample selection. Amino acid alignments were performed in PROMALS3D using the default parameters with structures of TyrA enzymes from plants and microbes with varying substrate specifies (*G. max* TyrAp; GmPDH1; PDB #5T8X, *H. influenzae* TyrAp81; HiPDH; 2PV7, and *Synechocystis* sp. PCC6803 TyrA$_a$82; SynADH; PDB #2F1K). Amino acid alignments from PROMALS3D were used to construct phylogenetic analyses using MEGA7. The analyses involved 130 amino acid sequences and all sites with less than 75% coverage were eliminated from the analysis. A neighbor-joining method was used to estimate evolutionary history using 1,000 bootstrap replicates (values shown at branches). The tree in FIG. 12 is a representative tree. Additional phylogenetic analyses were performed using the Maximum Likelihood method based on the Jones-Taylor-Thornton (JTT) matrix-based model, which gave overall similar results. All phylogenetic trees are drawn to scale, with branch lengths measured in the number of substitutions per site.

Recombinant Protein Expression and Purification and Site Directed Mutagenesis

Full length coding sequences from *Ochrobactrum intermedium* LMG 3301 (EEQ93947.1; OiTyrA), *Sediminispirochaeta smaragdinae* DSM 11293 (ADK80640.1; SsTyrA), and *Methanosaeta harundinacea* (KUK94425.1; MhTyrA) were optimized and inserted into pET28a vector using EcoRI and NdeI sites in frame with an N-terminal 6×-His tag.

For site directed mutagenesis of MhTyrA, plasmid template was diluted 100-fold, mixed with 0.04 U/μL Phusion DNA polymerase (Thermo), 0.2 mM dNTP's, 0.5 μM forward (5'-CATTCTGGCCGAAAGCCCG-GAACTGTATAGTAGC-3; SEQ ID NO: 167) and reverse (5'-GTTCCGGGCTTTCGGCCAGAATGCGGCC-CACAAAATC-3; SEQ ID NO: 168) mutagenesis primers, and 1× Phusion reaction buffer (Thermo), and then placed in a thermocycler for 98° C. for 30 s followed by 20 cycles of 10 s at 98° C., 20 s at 70° C., 4.5 min at 72° C. with a final extension at 72° C. for 10 min. The PCR products were purified with QIAquick Gel Extraction Kit (Qiagen), treated with DpnI (Thermo) to digest methylated template DNA for 30 min at 37° C., and then transformed into *E. coli* XL1-Blue cells. Plasmids were sequenced to confirm that no errors were introduced during PCR and cloning.

For recombinant protein expression, *E. coli* Rosetta2 (DE3) cells (Novagen) transformed with the above plasmids were cultured as previously reported. For protein purification, 20 mL of the *E. coli* supernatant expressing the appropriate plasmid was applied to a 1 mL HisTrap FF column for purification of the His-tagged recombinant protein using an ÄKTA FPLC system (GE Healthcare). After loading the supernatant, the column was washed with 20 column volumes of 90% buffer A (0.5 M NaCl, 0.2 M sodium phosphate and 20 mM imidazole) and 10% buffer B (0.5 M NaCl, 0.2 M sodium phosphate and 0.5 M imidazole) followed by elution with 100% buffer B. Fractions containing purified recombinant enzymes were pooled and desalted by Sephadex G50 column (GE Healthcare) size-exclusion chromatography into lysis buffer. The purity of purified proteins were analyzed by SDS-PAGE using ImageJ software. All protein purification steps were performed at 4° C. unless stated otherwise.

ADH and PDH Assays

ADH and PDH assays were performed using purified recombinant enzymes for SsTyrA and MhTyrA Wt and Q227E mutant, while the *E. coli* cell lysate was used for OiTyrA as expression and purification of this enzyme was unsuccessful. Reactions contained 0.8 mM substrate (arogenate or prephenate) and 0.8 mM cofactor (NADP+ or NAD+) together with reaction buffer (25 mM HEPES pH 7.6, 50 mM KCl, 10% (v/v) ethylene glycol). For OiTyrA assays containing cell lysates, reactions were incubated for 45 minutes and analyzed using HPLC as previously reported (Schenck et al., 2015). For pure enzymes, reactions were monitored every 10-15 seconds for reduced cofactor at A340 nm using a microplate reader (Tecan Genios). Kinetic parameters of purified recombinant enzymes were determined from assays containing varying concentrations of arogenate (39.1 μM-5 mM) or prephenate (39.1 μM-5 mM) substrate and monitored 10-15 seconds for reduced cofactor at A340 nm using a microplate reader (Tecan Genios). Kinetic parameters were determined by fitting initial velocity data to the Michaelis-Menten equation using Origin software (OriginLab) from technical replicate assays (n=3). Arogenate substrate was prepared by enzymatic conversion of prephenate (Sigma-Aldrich). All enzyme assays were conducted at a reaction time and protein concentration that were in the linear range and proportional to reaction velocity.

Modeling Microbial TyrA Enzymes

Computation models were made using SWISS-MODEL with default parameters to predict the structures of divergent TyrA enzymes. Enzymes that are more closely-related to plants (e.g. SsTyrA and MhTyrA) were modeled using GmPDH1, though this resulted in a poor model for BdTyrA, which falls within the outgroup. BdTyrA was additionally modeled using *Synechocystis* sp. PCC6803 ADH. Homology models were visualized using PyMOL.

Results
Phylogenetic Relationship of Plant and Microbial TyrAs

Previous studies suggested that plant TyrAs are not derived from an eukaryotic ancestor or through cyanobacterial endosymbiosis because they are most similar to other microbes including some proteobacteria (Schenck et al., 2017; Bonner et al., 2008; Dornfeld et al., 2014; Reyes-Prieto and Moustafa, 2012); however, their precise origin was unclear. To resolve the phylogenetic relationship of TyrA orthologs from divergent organisms including plants and microbes, here we performed structure-guided phylogenetic analyses using PROMALS3D to achieve alignment of TyrA orthologs with low sequence similarities (see methods) (Pei and Grishin, 2007). Three distinct clades were identified that contain: plant TyrAs together with those from algae, spirochaetes, α- and δ-proteobacteria (clade I, shaded blue in FIG. 12), TyrA orthologs from some archaea, fungi, γ-proteobacteria, and chloroflexi (clade II, shaded green), and TyrA orthologs from various microbes, which formed the outgroup and contains previously characterized microbial TyrA orthologs from *Synechocystis* sp. PCC 6803 and *Aquifex aeolicus* having very low sequence similarity (~30%) to plant TyrAs (clade III, FIG. 12). Interestingly, TyrAs from some spirochaetes lineages (some of which are known to cause harmful human diseases like Lyme disease) (Pritt et al., 2016) formed a subclade with plant and algae TyrAs within clade I using various phylogenetic methods (FIG. 12). These data suggest that Plantae TyrA may have been acquired through horizontal gene transfer (HGT) from an ancestor of one of these closely-related microbes.

Figure 15:
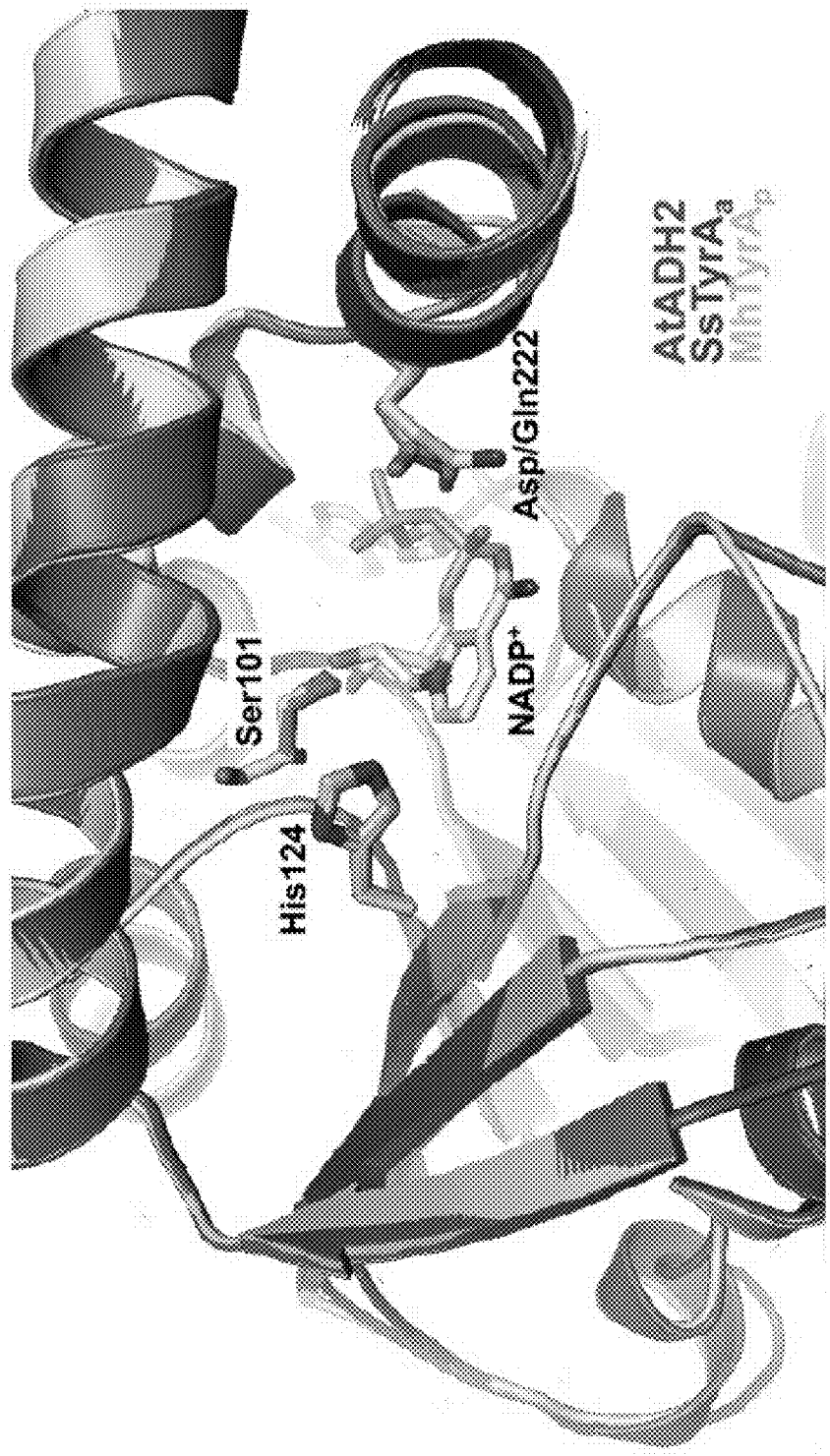
FIG. 15 shows structural conservation of residue 222 among clade I TyrA orthologs. Homology models of AtADH2 (blue), SsTyrAa (red), and MhTyrAp (yellow) show that they contain conserved catalytic residues (e.g. His and Ser, numbering based on GmPDH1 structure, which was used as the template for modeling). All three enzymes have an acidic residue at the active site 222: Asp in AtADH2 and SsTyrA and Gln in MhTyrA.

Microbial TyrA Orthologs Containing an Acidic 222 Residue 165 Prefer ADH Over PDH Activity The amino acid sequence alignment of TyrAs showed that the Asp222 residue, which is conserved across plant TyrAa was also highly conserved in clade I (FIG. 12). On the other hand, most sequences in clade II, including some archaea TyrA, have a non-acidic Gln residue at the corresponding 222 position (FIG. 12), similar to legume TyrAp 169 enzymes (Schenck et al., 2017). Homology models of representative TyrA from clade I—*Arabidopsis thaliana* ADH (AtADH2, Plantea) (Rippert and Matringe, 2002) and *Sediminispirochaeta smaragdinae* DSM 11293 (SsTyrA, spirocheates)—and clade II—*Methanosaeta harundinacea* (MhTyrA, archaea)—generated using GmPDH1 structure as the template indeed showed that their acidic and non-acidic residues, respectively, correspond to Asp222 in the active site of plant TyrA (FIG. 15). These data together suggest that TyrAs from clade I are likely arogenate-specific TyrAa enzymes, whereas more distantly-related microbial TyrAs from clade II are likely prephenate-specific TyrAp enzymes.

Figures 13A, 13B, 13C:
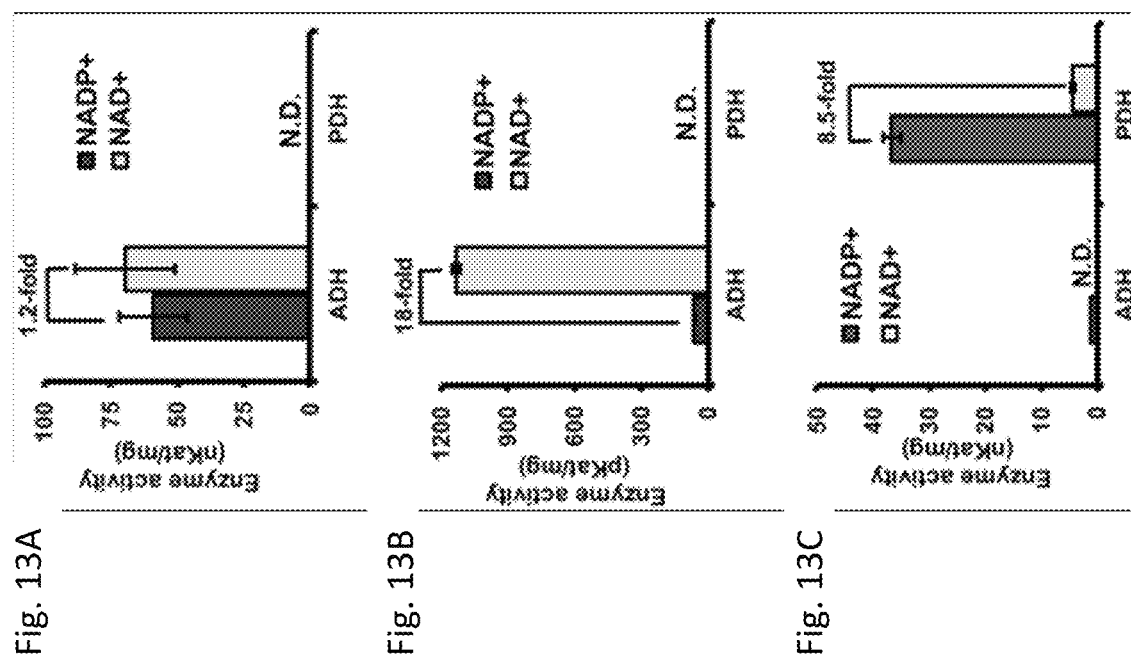
FIGS. 13A-13C show substrate and cofactor specificity of microbial TyrA orthologs. ADH and PDH assays were performed with 0.8 mM arogenate and prephenate, respectively, and 0.8 mM cofactor (NADP+, black; NAD+, gray).

To experimentally test if TyrAs from clade I have ADH activity, representative TyrA orthologs from two distinct subclades of clade I, spirochaetes (SsTyrA) and α-proteobacteria (*Ochrobactrum intermedium*; OiTyrA, FIG. 12), were expressed in *E. coli* as recombinant enzymes and biochemically characterized. SsTyrA and OiTyrA were chosen as they are located at key phylogenetic boundaries within clade I and contain residues required for cofactor binding and catalysis (FIG. 15). Purified SsTyrA recombinant enzyme showed ADH activity with a slight preference for NAD+ over NADP184+ cofactor; however, PDH activity was not detectable (FIG. 13A). Similarly, the *E. coli* cell lysate expressing OiTyrA had ADH but not PDH activity and strongly preferred NAD+ over NADP186+ cofactor (FIG. 13B), although the purification of OiTyrA was not successful due to low expression. These results demonstrate that microbial TyrA orthologs from clade I, which contain an acidic residue at the corresponding 222 position (FIG. 12), are arogenate specific TyrAa enzymes.

An Archaeon TyrA Containing a Non-Acidic Residue Prefers PDH Over ADH Activity

Figure 16:
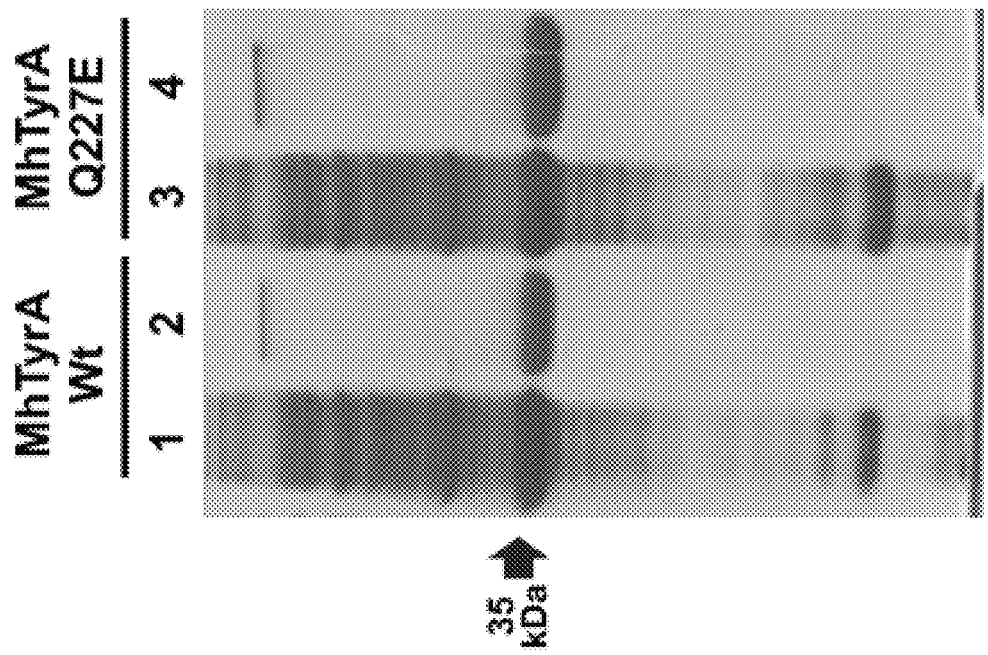
FIG. 16 shows purification of MhTyrAp wild-type (Wt) and Q227E recombinant enzymes. SDS-PAGE of supernatants and recombinant MhTyrApWt and Q227E purified using affinity chromatography facilitated by a 6×-His tag on the N-terminus of the protein. *E. coli* supernatants (lanes 1 & 3) expressing MhTyrA Wt and Q227E were applied to a column containing Ni-NTA resin and eluted with 500 mM imidazole containing buffer. Purified recombinant MhTyrA Wt (lane 2) and Q227 (lane 4) eluted at the appropriate size of ~34 kDa.
Figure 17:
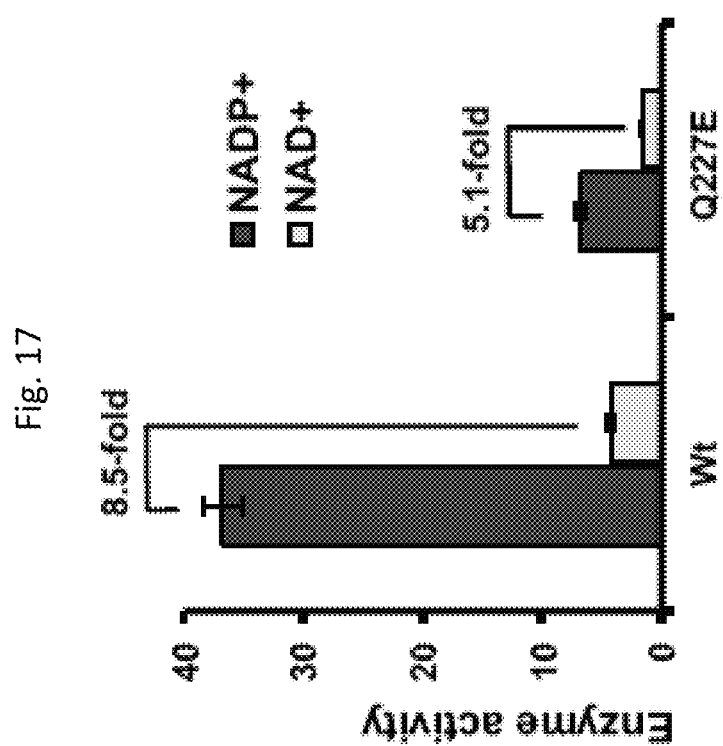
FIG. 17 shows cofactor specificity of MhTyrAp Q227E mutant. Using the preferred substrate (wild-type (Wt), prephenate, Q227E arogenate) cofactor specificity was tested with NADP+(black) and NAD+(gray). Mutation of MhTyrAp had not effect on its cofactor preference.

To test if TyrA orthologs from clade II, which contain a non-acidic residue at the corresponding 222 position, are prephenate specific TyrAp 193 enzymes, a representative archaeon TyrA from *Methanosaeta harundinacea* (MhTyrA) was biochemically characterized. MhTyrA was chosen as no TyrAs from its subclade of clade II have previously been characterized (FIG. 12). Also, MhTyrA is a monofunctional enzyme, while some archaea, fungi, and g-proteobacteria orthologs in clade II are bifunctional and have a chorismate mutase enzyme domain (Hudson et al., 1984; Shlaifer et al., 2017). MhTyrA was expressed in *E. coli* and the recombinant enzyme was purified to homogeneity using affinity-chromatography (FIG. 16) and used for biochemical analyses. Unlike plant and microbial TyrAa 200 orthologs from clade I, MhTyrA showed strong PDH and very weak ADH activity (FIG. 13C). Interestingly, MhTyrA strongly preferred NADP+ over NAD+ cofactor (FIG. 13C), like plant TyrAs. These results suggest that TyrA orthologs from clade II that have a non-acidic residue at the corresponding 222 position are TyrAp 204 enzymes that strongly prefer prephenate over arogenate substrate. A single Q227E mutation introduces ADH activity in an archaeon TyrAp To test if the non-acidic residue of MhTyrAp 206 at the corresponding 222 position (Gln227) is involved in substrate specificity, site-directed mutagenesis was performed on MhTyrAp 207 to replace Gln227 with glutamate and generate the MhTyrAp Q227E mutant. The 208 purified recombinant MhTyrAp Q227E enzyme (FIG. 16) showed decreased PDH activity with a substantial gain of ADH activity (FIG. 14, Table 6) without altering cofactor preference (FIG. 17).

TABLE 6

Kinetic analysis of MhTyrAp wild-type and Q227E mutant enzymes

| Enzyme | Substrate | $k_{cat}$ (s$^{-1}$) | $K_m$ (mM) | $k_{cat}/K_m$ (mM$^{-1}$ s$^{-1}$) |
| --- | --- | --- | --- | --- |
| Wild-type | prephenate | 2.44 ± 0.38 | 0.378 ± 0.02 | 6.44 ± 0.02 |
| Wild-type | arogenate | N.D. | N.D. | N.D. |
| Q227E | prephenate | 0.285 ± 0.17 | 2.669 ± 0.32 | 0.107 ± 0.01 |
| Q227E | arogenate | 0.704 ± 0.06 | 3.290 ± 0.22 | 0.213 ± 0.01 |

Figures 14A, 14B:
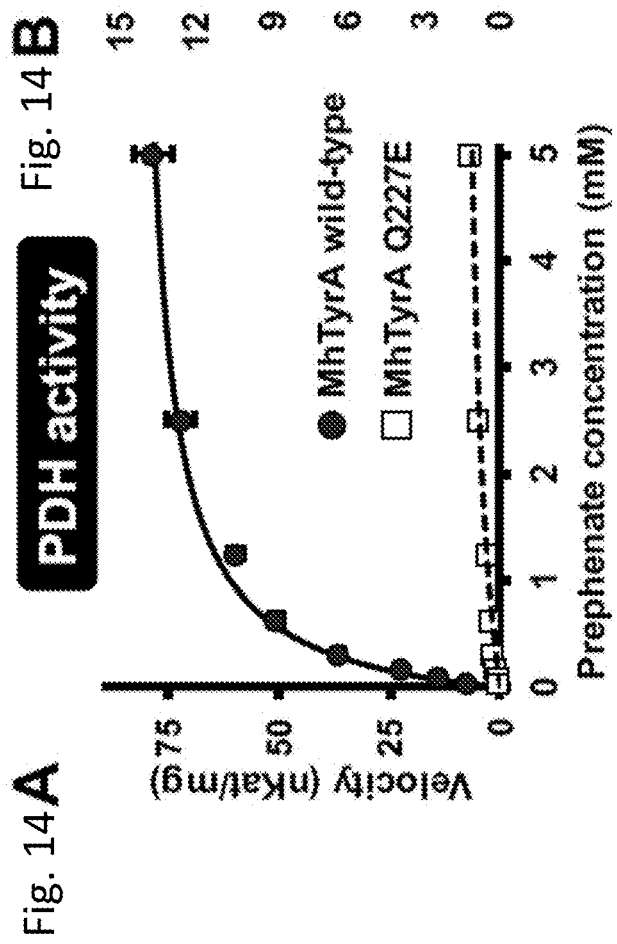
FIGS. 14A-14B show a kinetic analysis of MhTyrAp wild-type and Q227E mutant enzymes. Kinetic analysis was performed with MhTyrAp wild-type (filled circle) and Q227E mutant (open square) enzymes using various concentrations of prephenate (FIG. 14A) and arogenate (FIG. 14B). Initial velocity values at each substrate concentration were fit to the Michaelis-Menten equation using Origin software. Kinetic analyses were conducted for MhTyrA wild-type using 3.41 μg of purified recombinant enzyme, and 4.56 μg and 2.28 μg of purified recombinant Q227E using prephenate and arogenate, respectively.

N.D. activity below detection limit
Kinetic analyses were conducted as described in FIG. 14 legend Further kinetic analyses showed that wild-type MhTyrAp had a Km 211 of 378 μM and turnover rate ($k_{cat}$) of 2.4 s−1 using prephenate substrate and NADP+ 212 cofactor (FIG. 14, Table 6), which are comparable to previously characterized microbial TyrAp 213 enzymes. The very weak ADH activity of MhTyrAp 214 wild-type (FIG. 14, Table 6) precluded it from kinetic analysis using arogenate.

The Q227E mutant, on the other hand, exhibited almost 10-fold reduction in Km 216 for prephenate (2.4 μM), while the catalytic efficiency ($k_{cat}/K_m$) was reduced by 60-fold (0.1 vs. 6.4 mM−1 s−1, FIG. 3 and Table 1). The Q227E mutant displayed substantial ADH activity compared with wild-type with a $K_m$ 219 for arogenate of 3.3 mM, similar to that of Q227E for prephenate (2.7 mM, FIG. 14, Table 6) though still 10-fold higher than that of wild-type for prephenate (FIG. 14, Table 6) and other previously characterized TyrA$_a$ 221 enzymes. The Q227E mutant had roughly 2-fold higher catalytic efficiency with arogenate than with prephenate (0.2 vs. 0.1 mM−1 s−1, FIG. 13). These results demonstrate that the single nonacidic to acidic mutation (Q227E) can shift the substrate preference of MhTyrAp 224 from prephenate to arogenate, suggesting that a single residue is responsible for substrate specificity of archaea TyrAp enzymes.

Discussion

Previous studies suggest that microbes predominantly use a PDH-mediated pathway to synthesize Tyr, whereas plants mainly use an ADH-mediated Tyr pathway. In this study, structure-guided phylogenetic analyses from diverse organisms identified ADH-like sequences in some bacteria, e.g. spirochaetes, α- and δ-proteobacteria, which form a monophyletic clade with plant TyrAs (FIG. 12). Biochemical characterization further demonstrated that TyrAs from spirochaetes and α-proteobacteria indeed have ADH, but not PDH activity (FIGS. 13A, 13B). A native TyrA enzyme purified from the α-proteobacteria *Phenylobacterium immobile*, which belongs to the same α-proteobacteria genus found in clade I, was also previously shown to have ADH, but not PDH activity. Therefore, our study revealed that arogenate-specific TyrA$_a$ enzymes are more widely distributed in microbes than previously thought.

Figure 18:
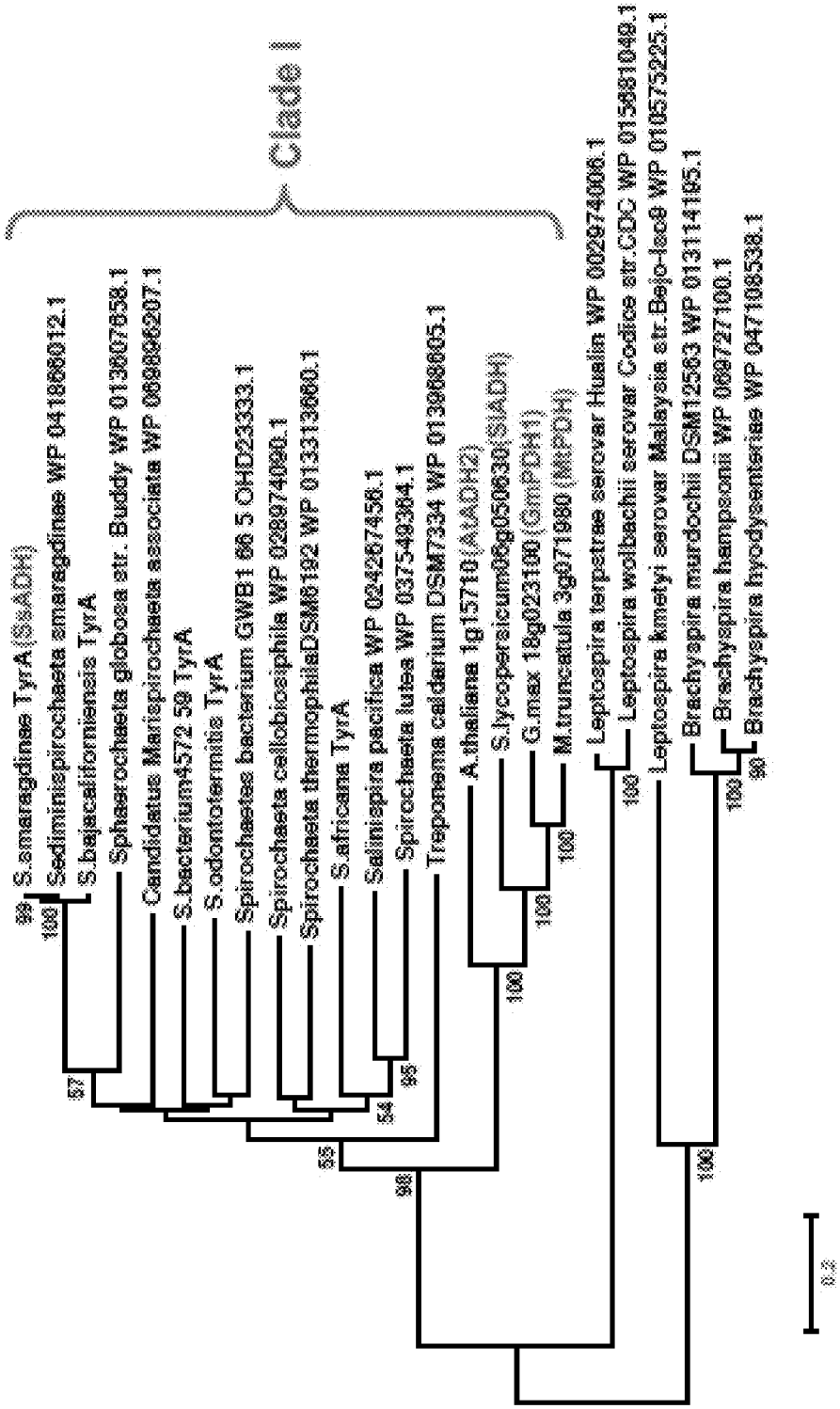
FIG. 18 shows phylogenetic analysis of Spirocheate TyrA orthologs. TyrA orthologs from Spirocheates were identified through BlastP® alignment tool searches using characterized Spirocheates TyrA (SsADH) targeting specific Spirocheates orders (Leptospirales, Brevinematales, and Brachyspirales) that were not included in FIG. 12. TyrA orthologs were identified in the Spirocheates, Leptospirales, and Brachyspirales, but not in Brevinematales. Neighbor-joining phylogenetic analysis performed in MEGA7 from the MUSCLE alignment of Spirocheate TyrA orthologs. Evolutionary distances were calculated using the Poisson correction method with 1,000 bootstrap replicates, which are indicated at the branches, with values less then 50% removed for clarity. Scale bar represents number of amino acid substitutions per site. TyrA orthologs from Spirocheates form a clade with SsADH and plant TryAs (characterized enzymes from this study or in previous studies shown in red). Whereas TyrA from Leptospirales and Brachyspirales group distinctly from clade I, suggesting that only a portion of Spirocheate have plant-like TyrA enzymes that group within clade I. Full genus and species followed by NCBI accession number are indicated for Spiorcheate sequences not included in the original phylogenetic analyses (FIG. 12).

Previous evolutionary studies revealed that plant aromatic amino acid pathway enzymes are derived from a wide range of, and sometimes unexpected microbial origins. For example, plant shikimate kinase is most likely derived from cyanobacteria endosymbiosis whereas plant prephenate aminotransferase and arogenate dehydratase involved in Phe biosynthesis are sister to Chlorobi/Bacteroidetes orthologs. However, the evolutionary origin of plant TyrAs is currently unknown. TyrAs from some spirochaetes were more closely-related to plant and algae TyrAas than other microbial TyrAs from clade I (FIG. 12) and, like Plantae TyrAa enzymes, had a conserved acidic residue at the corresponding 222 position. BlastP® alignment tool searches across different spirocheates genomes showed that plant-like TyrAs are restricted to the order Spircheatales, and absent in Leptospirales, Brevinematales, and Brachyspirales (FIG. 18). Thus, the current result suggests that the common ancestor of algae and plants acquired a TyrAa enzyme from a spirocheates ancestor likely through a novel HGT event, rather than from an a-proteobacteria through mitochondria symbiosis.

The archaeon MhTyrA from clade II preferred PDH over ADH activity (FIG. 13C) and had a non-acidic residue at the 222 position (FIG. 12). This is consistent with previously-characterized clade II TyrA enzymes from γ-proteobacteria and fungi, which also preferred PDH over ADH activity though they belonged to distinct subclades (FIG. 12). As almost all TyrA sequences within clade II have a non-acidic residue (Gln or Asn) at the corresponding 222 position, except for Chloroflexi TyrAs (FIG. 12), they are likely prephenate-specific TyrAp enzymes. In plant TyrAs, an acidic residue at the corresponding 222 position confers ADH activity and when mutated to a non-acidic Gln, switches to PDH activity (Schenck et al., 2017). The reciprocal mutation (Gln to Glu) on MhTyrAp reduced PDH activity while introducing ADH activity (FIG. 14, Table 6). These data suggest that mutation of the non-acidic to an acidic residue at the corresponding 222 position played a key role in the evolution of arogenate-specific TyrA$_a$ 266 enzymes in microbes from clade I that gave rise to plant TyrAs.

Figure 19A:
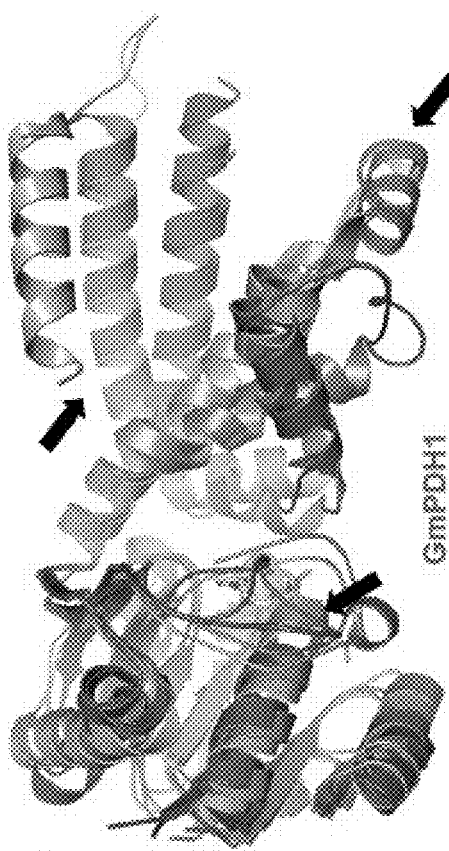
FIGS. 19A-19B show conservation of global conformation in divergent microbial TyrA orthologs. One representative sequence from the outgroup (*Bifidobacterium dentium*, BdTyrA) was chosen to determine active site architecture conservation in divergent microbial TyrAs. Models for BdTyrA (red), were created in SWISS-MODEL using GmPDH1 (light red; BdTyrA (GmPDH1)) and a more similar sequence from *Synechocystis* (dark red; BdTyrA (*Synechocystis* ADH)) as templates.
Figure 19B:
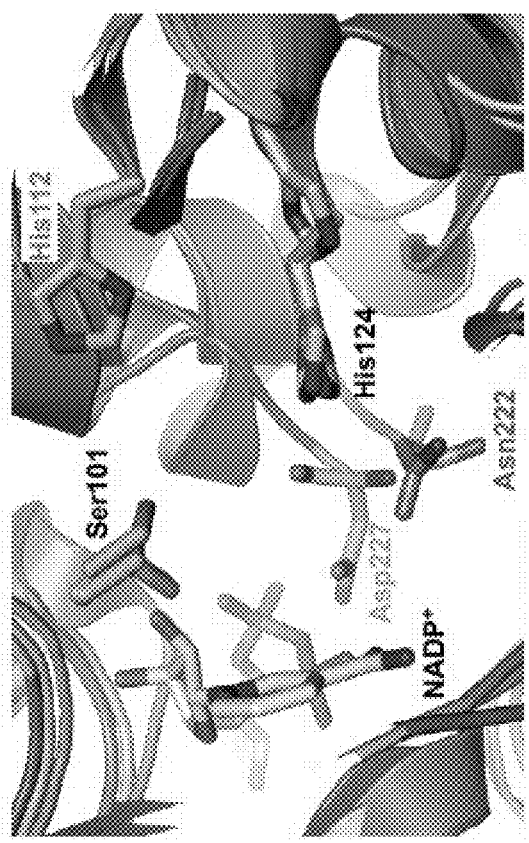

The outgroup (clade III) appears to contain TyrA enzymes with both PDH and ADH activity. Homology models of a microbial TyrAs from the outgroup (e.g., *Bifidobacterium dentium* TyrA; BdTyrA) were compared to previously crystallized GmPDH1 and *Synechocystis* ADH to determine if the substrate specificity mechanism of TyrAs from clade I and II are also conserved in clade III TyrAs (FIG. 19). The global conformations of these divergent TyrA proteins from clade I and III are similar in structure, though there are some differences, such as additional α-helices around the C-terminal dimerization domain (FIG. 19). All structures have conserved catalytic Ser101 and His124 that directly interact with ring hydroxyl of arogenate and prephenate substrate (Schenck et al., 2017), suggesting that the key catalytic residues have been maintained across divergent TyrAs. However, the two loop regions surrounding and recognizing the substrate side chain, which contain the 222 residue and critical for substrate specificity (Schenck et al., 2017), are not well conserved in clade III as compared to clade I TyrAs (FIG. 19). This makes it difficult to confidently assign a corresponding residue in clade III TyrAs to the 222 position of clade I TyrAs (FIG. 12). Thus, clade III TyrAs likely use a different molecular mechanism(s) for their substrate specificity than plant and closely-related microbial TyrAs from clade I and II.

In conclusion, the current study revealed that arogenate-specific TyrAa enzymes evolved in some bacterial lineages, through the acquisition of an acidic residue at the 222 position, which later gave rise to the TyrAs of algae and land plants likely through a novel HGT event. More recently, the same residue was mutated back to a non-acidic residue uniquely in legume plants, which resulted in prephenate-specific TyrA$_p$ enzymes (Schenck et al., 2017). Thus, in the course of TyrA enzyme evolution, microbial TyrA$_p$ were converted into microbial TyrA$_a$ and then to legume-specific TyrA$_p$ by altering the same active site residue from a non-acidic to an acidic, and then back to a non-acidic residue. Previous studies proposed that the ubiquitous presence of the ADH-mediated Tyr pathway among photosynthetic organisms is to avoid futile cycling of tocopherol and plastoquinone biosynthesis from HPP. Identification of arogenate-specific TyrA among many non-photosynthetic microbes may require revisiting the biological significance of the ADH versus PDH-mediated Tyr biosynthetic pathways in diverse organisms. Given that arogenate and prephenate substrate specificity of TyrAs can be readily converted by a single residue (FIG. 14, Table 6) (Schenck et al., 2017), there must be significant selection pressure to maintain the acidic 222 residue and thus ADH activity in many organisms. The molecular mechanism and the key amino acid residue regulating the biochemical properties of diverse TyrAs also enables the optimization of Tyr biosynthesis via two alternative Tyr biosynthetic pathways in both plants and microbes for enhanced production of pharmaceutically important natural products derived from Tyr (e.g. morphine and vitamin E).

REFERENCES FOR EXAMPLE 2

Bonner, C. A., Disz, T., Hwang, K., Song, J., Vonstein, V., Overbeek, R., et al. (2008). Cohesion group approach for evolutionary analysis of TyrA, a protein family with wide-ranging substrate specificities. *Microbiol. Mol. Biol. Rev. MMBR* 72, 13-53. doi:10.1128/MMBR.00026-07.

Dornfeld, C., Weisberg, A. J., K C, R., Dudareva, N., Jelesko, J. G., and Maeda, H. A. (2014). Phylobiochemical characterization of class-Ib aspartate/prephenate aminotransferases reveals evolution of the plant arogenate phenylalanine pathway. *Plant Cell* 26, 3101-14. doi: 10.1105/tpc.114.127407.

Hudson, G., Wong, V., and Davidson, B. (1984). Chorismate mutase/prephenate dehydrogenase from *Escherichia coli* K12: purification, characterization, and identification of a reactive cysteine. *Biochemistry* 23, 6240-6249.

Legrand, P., Dumas, R., Seux, M., Rippert, P., Ravelli, R., Ferrer, J.-L., et al. (2006). Biochemical characterization and crystal structure of *Synechocystis* arogenate dehydrogenase provide insights into catalytic reaction. *Structure* 14, 767-776. doi:10.1016/j.str.2006.01.006.

Reyes-Prieto, A., and Moustafa, A. (2012). Plastid-localized amino acid biosynthetic pathways of Plantae are predominantly composed of non-cyanobacterial enzymes. *Sci. Rep.* 2, 955-967. doi:10.1038/srep00955.

Rippert, P., and Matringe, M. (2002). Purification and kinetic analysis of the two recombinant arogenate dehydrogenase isoforms of *Arabidopsis thaliana. Eur. J. Biochem.* 269, 4753-4761. doi:10.1046/j.1432-1033.2002.03172.x.

Schenck, C. A., Chen, S., Siehl, D. L., and Maeda, H. A. (2015). Non-plastidic, tyrosine-insensitive prephenate dehydrogenases from legumes. *Nat. Chem. Biol.* 11, 52-57. doi:10.1038/nchembio.1693.

Schenck, C. A., Holland, C. K., Schneider, M. R., Men, Y., Lee, S. G., Jez, J. M., et al. (2017). Molecular basis of the evolution of alternative tyrosine biosynthetic routes in plants. *Nat. Chem. Biol.* advance online publication. doi: 10.1038/nchembio.2414.

SEQUENCE LISTING (247 sequences)

SEQ ID NO: 1 - protein, 268 aa, Artificial Sequence
  Synthetic: MtPDH C220D
MSSSSKSLKIGIVGFGTFGQFLANTMIKQGHTLTATSRTDYSQLCDQMGIHFFRDITAFLDADMDVILLCTSISSLSEVVGSMPLACLKRPTLFVDVLSVKEHPKNLLLKVLPEESDILCTHPMFGPVSGKNGWQNLTFMFDKVRIKDEVTCSKFLQIFASEGCKMVEMSCEEHDKAAAKSQFITHTIGRTLAEMDIKSTPIDTKGFQTLVELKKPVMGDSFDLYSGLFVYNRFARQELENLEHALHKVKEMLVQRIDEGQNPERTES

SEQ ID NO: 2 - protein, 271 aa, Artificial Sequence
  Synthetic: GmPDH1 N222D
MSTSSSSQSLKIGIVGFGNFGQFLAKTMIKQGHTLTATSRSDYSELCLQMGIHFFRDVSAFLTADIDVIVLCTSILSLSEVVGSMPLTSLKRPTLFVDVLSVKEHPRELLLRELPEDSDILCTHPMFGPQTAKNGWTDHTFMYDKVRIRDEVICSNFIQIFATEGCKMVQMSCEEHDRAAAKSQFITHTIGRTLGEMDIQSTPIDTKGFETLVKLKETMMRDSFDLYSGLFVYNRFARQELENLEHALHKVKETLMIQRTNGEQGHKRTES

SEQ ID NO: 3 - protein, 274 aa, Artificial Sequence
  Synthetic: Gmax11g35760 Amino acid residue corresponding to position 220 of SEQ ID NO: 1 Engineered to aspartic acid
MTTMSTSSSSQSLKIGIVGFGNFGQFLAKTMIKQGHTLTATSRSDYSQLCLQMGIHFFRDVSAFLAADIDVIVLCTSILSLSEVVGSMPLTSLKRPTLFVDVLSVKEHPRELLLRELPEDSDILCTHPMFGPQTANNGWTDHTFMYDKVRIRDEATCSSFIQIFATEGCKMVQMSCEEHDRAAAKSQFITHTIGRTLGEMDIQSTPIDTKGFETLVKLKETMMRDSFDLYSGLFVYNRFARQELENLEHAFYKVKETLMIQRSNGEQGHKRTES

SEQ ID NO: 4 - protein, 274 aa, Artificial Sequence
  Synthetic: Bbituminosa68922 Amino acid residue corresponding to position 220 of SEQ ID NO: 1 Engineered to aspartic acid
FSTMSTSSSFQNLKIGIVGFGNFGQFLAKTMIKQGHTITATSRSDYSQLSLQMGIHFFRDISEFLAVDIDVIVLCTSILSLSEVVGSMPLTSLKRPTLFVDVLSVKEHPREVLLRVLPEDSDILCTHPMFGPQTAKNGWKDHTFMFDKVRIRDEATCSNFIQIFASEGCKMVQMSCEEHDRAAAKSQFITHTIGRTLGEMDIQSTPIDTTGFETLVKLKETMMKDSFDLYSGLFVYNRFARQELENLEHALRKVKETLMIQSIDEEQDKKITES

SEQ ID NO: 5 - protein, 269 aa, Artificial Sequence
  Synthetic: Pvulgaris01g247200 Amino acid residue corresponding to position 220 of SEQ ID NO: 1 Engineered to aspartic acid
MSSSSSSSQSLKIGIVGFGTFGQFLAKTMIKQGHSLTATSRSDYSDLCLQMGIHFYGDVTAFLASDIDVIVLCTSILSLSEVVGSMPLASLKRPTLFVDVLSVKEHPRELLLRELPEHSDILCTHPMFGPVSGKNGWKGLTFMYDKVRIRNEAICSSFIQIFASEGCKMVQMTCEEHDKAAAKSQFITHTIGRTLAEMDIKSTPIDTKGFEELVKLKETMIGDSFDLFSGLFVYNRFARQELENLEHALQKVKETLVERKNEEQGQEKN

SEQ ID NO: 6 - protein, 265 aa, Artificial Sequence
  Synthetic: Gglabra9954 Amino acid residue corresponding to position 220 of SEQ ID NO: 1 Engineered to aspartic acid
NSNSQSLKIGIVGFGTFGQFLAKTMIKQGHTLTATSRTDYSQLCIQLGIHFFRDVSAFLDADMDVILLCTSIPSLSEVVGSMPLTRLKRPTLFVDVLSVKEHPRNLLLRVLPEESDILCTHPMFGPVSGKNGWKDLIFMYDKVRVRDEVTCSKLLQIFASEGCKMVEMSCEEHDKAAAKSQFITHTIGRSLAEMDIKSTPIDTKGFQALVQMKETVMGDSSDLYSGLFLHNRFARQELENLEHALYKVKEMLVQKMNEEQSPERT

SEQ ID NO: 7 - protein, 266 aa, Artificial Sequence
  Synthetic: Amembranaceus5597 Amino acid residue corresponding to position 220 of SEQ ID NO: 1 Engineered to aspartic acid
ASSQSLKIGIVGFGTFGQFLAKTMMKQGHTLTTTSRSDYSEICNQMGIHFFRDVTTLLDADMDVLLLCTSISSLSEVVGSMPLTRLKRPTLFVDVLSVKEHPRNLLLQVLPEESDILCTHPMFGPVSGKNGWKELTFMFDKVRIRDQVTCSKFLQIFETEGCKMVEMSCEEHDKAAAKSQFITHTIGRTLAEMDIKSTPIDTKGFQALNQLKDTVMGDSFDLYSGLFVYNRFARQELENLEHALHKVKEMLVPRINEEHGPERTES

SEQ ID NO: 8 - protein, 269 aa, Artificial Sequence
  Synthetic: Peanut PDH/ADH Amino acid residue corresponding to position 220 of SEQ ID NO: 1 Engineered to aspartic acid
MSSSHSQNMKIGIVGFGTFGQFLAKTIIKQGHTITATSRSDYSHLCLQMGIHFFRDMSAFLDAGNDVILLCTSILSLAEVMRSMPLTCLKRPTLFVDVLSVKEHPRNLLLRTLPGELDILCTHPMFGPISGKDGWKDLTFMYDKVRIQDEAKCSRFLQIFETEGCRMVEMSCEEHDKAAARSQFITHTIGRTLGEMDIRSTPIDTKGFETLVQLKETTMKDSFDLYSGLFTHNRFAIQELENLEHALFKVKEMLVQMMKEEQGQEKTES

SEQ ID NO: 9 - protein, 281 aa, Artificial Sequence
  Synthetic: AduranensisL1RYW Amino acid residue corresponding to position 220 of SEQ ID NO: 1 Engineered to aspartic acid
MSSSHSQNMKIGIVGFGTFGQFLAKTIIKQGHTITATSRSDYSHLCLQMGIHFFSDMSAFLDAENDVILLCTSILSLAEVMRSMPLTCLKRPTLFVDVLSVKEHPRNLLLRTLPGELDILCTHPMFGPISGKDGWKDLTFMYDKVRIQDEAKCSRFLQIFETEIKVKKSNDDDPNLVMNSSKVNYYFRMYIVCITQGCRMVEMSCEEHDKAAARSQFITHTIGRYMKETTMKDSFDLYSGLFTHNRFAIQELENLEHALFKVKEMLVQRMKEEQGQEKTES

SEQ ID NO: 10 - protein, 266 aa, Artificial Sequence
  Synthetic: MtncADH D220C
MSNSPSLKIGIVGFGSFGQFLAKTMIKQGHTLTATSRTDYSHTCLQLGIQFFRDVGTFIEANNDVILICTSIMSFTKVLSSMPLACLKKPTTLFVDVLSVKEHPREVLLRVLPEESDILCTHPMFGPESGKNGWKDLNFMYDKVRIHDEATCSNFLHIFASEGCKMLQMSCEEHDKIAAKSQFITHTIGRTLAEMDIESTPIDTKGFQTLTQLKNTTMRCSFDLYSGLFVHNRFAKQELENLQRALDRVKEMLVQRMREELGPEKD

SEQ ID NO: 11 - protein, 266 aa, Artificial Sequence
  Synthetic: MtncADH D220N
MSNSPSLKIGIVGFGSFGQFLAKTMIKQGHTLTATSRTDYSHTCLQLGIQFFRDVGTFIEANNDVILICTSIMSFTKVLSSMPLACLKKPTTLFVDVLSVKEHPREVLLRVLPEESDILCTHPMFGPESGKNGWKDLNFMYDKVRIHDEATCSNFLHIFASEGCKMLQMSCEEHDKIAAKSQFITHTIGRTLAEMDIESTPIDTKGFQTLTQLKNTTMRNSFDLYSGLFVHNRFAKQELENLQRALDRVKEMLVQRMREELGPEKD

SEQ ID NO: 12 - protein, 358 aa, Artificial Sequence
  Synthetic: AtADH2 D241N
MLLHFSPAKPLISPPNLRRNSPTFLISPPRSLRIRAIDAAQIFDYETQLKSEYRKSSALKIAVLGFGNFGQFLSKTLIRHGHDLITHSRSDYSDAANSIGARFFDNPHDLCEQHPDVVLLCTSILSTESVLRSFPFQRLRRSTLFVDVLSVKEFPKALFIKYLPKEFDILCTHPMFGPESGKHSWSGLPFVYDKVRIGDAASRQERCEKFLRIFENEGCKMVEMSCEKHDYYAAGSQFVTHTMGRVLEKYGVESSPINTKGYETLLDLVENTSSNSFELFYGLFMYNPNALEQLERLDMAFESVKKELFGRLHQQYRKQMFGGEVQSPKKTEQKLLNDGGVVPMNDISSSSSSSSSSS

SEQ ID NO: 13 - protein, 358 aa, Artificial Sequence
  Synthetic: AtADH2 D241C
MLLHFSPAKPLISPPNLRRNSPTFLISPPRSLRIRAIDAAQIFDYETQLKSEYRKSSALKIAVLGFGNFGQFLSKTLIRHGHDLITHSRSDYSDAANSIGARFFDNPHDLCEQHPDVVLLCTSILSTESVLRSFPFQRLRRSTLFVDVLSVKEFPKALFIKYLPKEFDILCTHPMFGPESGKHSWSGLPFVYDKVRIGDAASRQERCEKFLRIFENEGCKMVEMSCEKHDYYAAGSQFVTHTMGRVLEKYGVESSPINTKGYETLLDLVENTSSCSFELFYGLFMYNPNALEQLERLDMAFESVKKELFGRLHQQYRKQMFGGEVQSPKKTEQKLLNDGGVVPMNDISSSSSSSSSSS

SEQ ID NO: 14 - protein, 270 aa, Artificial Sequence
  Synthetic: AduranensisP7PS3 - amino acid residue at a position corresponding to amino acid residue 220 of SEQ ID NO: 10 (MtncADH D220C) Engineered to asparagine
MSSSSSSSSLKIGIIGFGTFGQFLAKTMIKQGHTLTATSRTDYSQHSLQLGIQFFRDVNEFLEADNDVILLCTSIISLSGVLDSMPISSLKRSSTLFVDVLSVKEHPRELLLRKLPEESDILCTHPMFGPESGKNGWKDLTFMYDKVRIRDEVICSNFLNIFATEGCRMLQMTCEEHDKLAAKSQFITHTIGRTLAEMDAKFTPIDTKGFQTLVQLKDSTMRNSFDLYSGLFLHNRFARQELENLEHALHKVKEMLVQRMSDVLGTEKTA

SEQ ID NO: 15 - protein, 270 aa, Artificial Sequence
  Synthetic: AduranensisP7PS3 - amino acid residue at a position corresponding to amino acid residue 220 of SEQ ID NO: 10 (MtncADH D220C) Engineered to cysteine
MSSSSSSSSLKIGIIGFGTFGQFLAKTMIKQGHTLTATSRTDYSQHSLQLGIQFFRDVNEFLEADNDVILLCTSIISLSGVLDSMPISSLKRSSTLFVDVLSVKEHPRELLLRKLPEESDILCTHPMFGPESGKNGWKDLTFMYDKVRIRDEVICSNFLNIFATEGCRMLQMTCEEHDKLAAKSQFITHTIGRTLAEMDAKFTPIDTKGFQTLVQLKDSTMRCSFDLYSGLFLHNRFARQELENLEHALHKVKEMLVQRMSDVLGTEKTA

SEQ ID NO: 16 - protein, 270 aa, Artificial Sequence
  Synthetic: AipaensisP6A5Q - amino acid residue at a position corresponding to amino acid residue 220 of SEQ ID NO: 10 (MtncADH D220C) Engineered to asparagine
MSSSSSSSALKIGIVGFGTFGQFLAKTMIKQGHTLTATSRTDYSQHSLQPGIQFFRDVNEFLEADNDVILICTSIISLSGVLDSMPISSLKRSSTLFVDVLSVKEHPRELLLRKLPEESDILCTHPMFGPESGKNGWKDLTFMYDKVRIRDEVICSNFLNIFATEGCRMLQMTCEEHDKLAAKSQFITHTIGRTLAEMDAKFTPIDTKGFQTLVQLKDSTMRNSFDLYSGLFLHNRFARQELENLEHALHKVKEMLVQRMSDVLGTEKTA

SEQ ID NO: 17 - protein, 270 aa, Artificial Sequence
  Synthetic: AipaensisP6A5Q - amino acid residue at a position corresponding to amino acid residue 220 of SEQ ID NO: 10 (MtncADH D220C) Engineered to cysteine
MSSSSSSSALKIGIVGFGTFGQFLAKTMIKQGHTLTATSRTDYSQHSLQPGIQFFRDVNEFLEADNDVILICTSIISLSGVLDSMPISSLKRSSTLFVDVLSVKEHPRELLLRKLPEESDILCTHPMFGPESGKNGWKDLTFMYDKVRIRDEVICSNFLNIFATEGCRMLQMTCEEHDKLAAKSQFITHTIGRTLAEMDAKFTPIDTKGFQTLVQLKDSTMRCSFDLYSGLFLHNRFARQELENLEHALHKVKEMLVQRMSDVLGTEKTA

SEQ ID NO: 18 - protein, 257 aa, Artificial Sequence
  Synthetic: Gglabra8888 - amino acid residue at a position corresponding to amino acid residue 220 of SEQ ID NO: 10 (MtncADH D220C) Engineered to asparagine
SSSTLKIGIVGFGSFGQFLAKTMIKQGHTLRATSRTDYSHLCLQMGIRFFRGVIAFVEADNDVILICTSILSLSEVLRSMPLSRLKRPTLFVDVLSVKEHPRDLLLRVLPEDSDILCTHPMFGPESGKDGWKDLTFVYDKVRIRDEAICSNFLHIFASEGCRMLQMSCEEHDKVAAKSQFITHTIGRTLEEMNIESTPIDTKGFQTLVQLKDTTMRNSFDLYSGLFIHNRFAKQELENLEHALHNVKEMLVQKMNED

SEQ ID NO: 19 - protein, 257 aa, Artificial Sequence
  Synthetic: Gglabra8888 - amino acid residue at a position corresponding to amino acid residue 220 of SEQ ID NO: 10 (MtncADH D220C) Engineered to cysteine
SSSTLKIGIVGFGSFGQFLAKTMIKQGHTLRATSRTDYSHLCLQMGIRFFRGVIAFVEADNDVILICTSILSLSEVLRSMPLSRLKRPTLFVDVLSVKEHPRDLLLRVLPEDSDILCTHPMFGPESGKDGWKDLTFVYDKVRIRDEAICSNFLHIFASEGCRMLQMSCEEHDKVAAKSQFITHTIGRTLEEMNIESTPIDTKGFQTLVQLKDTTMRCSFDLYSGLFIHNRFAKQELENLEHALHNVKEMLVQKMNED

SEQ ID NO: 20 - protein, 264 aa, Artificial Sequence
  Synthetic: Bbituminosa16676 - amino acid residue at a position corresponding to amino acid residue 220 of SEQ ID NO: 10 (MtncADH D220C) Engineered to asparagine
TWSLKIGIVGFGSFGQFLAKTMIKQGHTLRATSRTDYSHLCLQMGIQFFRDVAAFLEADNDVILICTSILSLSEVLSSMPLTRLNRPILFVDVLSVKEHPRNLLLRVLPEESDILCTHPMFGPDSGKYGWKDLTFVYDKVRIRDEAICSNFLQIFASEGCRMLQMSCEEHDKIAAKSQFITHTIGRTLAEMDIKSTPIDTTGFRTLVQLKDTTIRNSFDLYNGLFLRNRFAVQELENLENALHKVKEILVQRKSEELGLEKTEC

SEQ ID NO: 21 - protein, 264 aa, Artificial Sequence
  Synthetic: Bbituminosa16676 - amino acid residue at a position corresponding to amino acid residue 220 of SEQ ID NO: 10 (MtncADH D220C) Engineered to cysteine
TWSLKIGIVGFGSFGQFLAKTMIKQGHTLRATSRTDYSHLCLQMGIQFFRDVAAFLEADNDVILICTSILSLSEVLSSMPLTRLNRPILFVDVLSVKEHPRNLLLRVLPEESDILCTHPMFGPDSGKYGWKDLTFVYDKVRIRDEAICSNFLQIFASEGCRMLQMSCEEHDKIAAKSQFITHTIGRTLAEMDIKSTPIDTTGFRTLVQLKDTTIRCSFDLYNGLFLRNRFAVQELENLENALHKVKEILVQRKSEELGLEKTEC

SEQ ID NO: 22 - protein, 266 aa, Artificial Sequence
  Synthetic: GmncADH - amino acid residue at a position corresponding to amino acid residue 220 of SEQ ID NO: 10 (MtncADH D220C) Engineered to asparagine
MSTWSLKIGVVGFGSFGQFLAKTMIKQGHTLRATSRTDYSLLCLPMGIQFFRDVAAFLEADNDVILVCTSILSLSEVLSSMPLTCLKRSTLFVDVLSVKEHPRNLLIKVLPEESDILCTHPMFGPDSGKDGWQDLTFVYDKVRIRDEAICSSFLHIFASEGCRMLQMSCEEHDKIAAKSQFITHTIGRTLAEMDIKSTPIDTKGFHSLVQLKDTTIRNSFDLYSGLFLHNRFAVQELENLEHALHKVKEMLVQRKSEELGLEKTEC

SEQ ID NO: 23 - protein, 266 aa, Artificial Sequence
  Synthetic: GmncADH - amino acid residue at a position corresponding to amino acid residue 220 of SEQ ID NO: 10 (MtncADH D220C) Engineered to cysteine
MSTWSLKIGVVGFGSFGQFLAKTMIKQGHTLRATSRTDYSLLCLPMGIQFFRDVAAFLEADNDVILVCTSILSLSEVLSSMPLTCLKRSTLFVDVLSVKEHPRNLLIKVLPEESDILCTHPMFGPDSGKDGWQDLTFVYDKVRIRDEAICSSFLHIFASEGCRMLQMSCEEHDKIAAKSQFITHTIGRTLAEMDIKSTPIDTKGFHSLVQLKDTTIRCSFDLYSGLFLHNRFAVQELENLEHALHKVKEMLVQRKSEELGLEKTEC

SEQ ID NO: 24 - protein, 272 aa, Artificial Sequence
  Synthetic: SolyncADH - amino acid residue at a position corresponding to amino acid residue 220 of SEQ ID NO: 10 (MtncADH D220C) Engineered to asparagine
MSSSSSCQPKTLRIGIIGFGPFAQFLAKTMMKQGHCIHVTSRSDYSELCTDLGILFFRDMGAFLESDNEVIMISTSILSLSQVVESIPFNCLKRPTLFVDVLSVKEHPKDVLLRMMPRECDLLCTHPMFGPESGKDGWEDLTFMYDMVRIRDQPLCSSFLHIFSSEGCKMLEMTCEKHDRLAAQSQFLTHTIGRILSEMEVEPTPIDTKGFQKLVQVKESSVKNSFDLFSGLFIHNRFARQQMKNLEVALEKTKEKLQERSKELQDPIISKF

SEQ ID NO: 25 - protein, 272 aa, Artificial Sequence
  Synthetic: SolyncADH - amino acid residue at a position corresponding to amino acid residue 220 of SEQ ID NO: 10 (MtncADH D220C) Engineered to cysteine
MSSSSSCQPKTLRIGIIGFGPFAQFLAKTMMKQGHCIHVTSRSDYSELCTDLGILFFRDMGAFLESDNEVIMISTSILSLSQVVESIPFNCLKRPTLFVDVLSVKEHPKDVLLRMMPRECDLLCTHPMFGPESGKDGWEDLTFMYDMVRIRDQPLCSSFLHIFSSEGCKMLEMTCEKHDRLAAQSQFLTHTIGRILSEMEVEPTPIDTKGFQKLVQVKESSVKCSFDLFSGLFIHNRFARQQMKNLEVALEKTKEKLQERSKELQDPIISKF

SEQ ID NO: 26 - protein, 270 aa, Artificial Sequence
  Synthetic: Graimondii06g129300.1 - amino acid residue at a position corresponding to amino acid residue 220 of SEQ ID NO: 10 (MtncADH D220C) Engineered to asparagine
MSSSSSLPLQTLKIGIVGFGTFGQFLAKTMIKQGHTTRATSRTDYSQLCHQLDVPFFRDVIPFLEADNDVILICTSILSLSEVLNSMPLRRLKRHTLFVDVLSVKEHPRNVLLQVLPENMDVLCTHPMFGPESGKNGWKDLPLVYEKVRVRNETRCSSFLHIFESEGCRMVEMSCEEHDKVAARSQFLSHSIGRILAEMGIESTSMNTKSFETLVKLKESATNNSFDLFSGLFIHNRFAQQELMNLEQSFEKVKQRLLKKMSEQQSLSSV

SEQ ID NO: 27 - protein, 270 aa, Artificial Sequence
  Synthetic: Graimondii06g129300.1 - amino acid residue at a position corresponding to amino acid residue 220 of SEQ ID NO: 10 (MtncADH D220C) Engineered to cysteine
MSSSSSLPLQTLKIGIVGFGTFGQFLAKTMIKQGHTTRATSRTDYSQLCHQLDVPFFRDVIPFLEADNDVILICTSILSLSEVLNSMPLRRLKRHTLFVDVLSVKEHPRNVLLQVLPENMDVLCTHPMFGPESGKNGWKDLPLVYEKVRVRNETRCSSFLHIFESEGCRMVEMSCEEHDKVAARSQFLSHSIGRILAEMGIESTSMNTKSFETLVKLKESATNCSFDLFSGLFIHNRFAQQELMNLEQSFEKVKQRLLKKMSEQQSLSSV

SEQ ID NO: 28 - protein, 278 aa, Artificial Sequence
  Synthetic: Tcacao1EG010641t1 - amino acid residue at a position corresponding to amino acid residue 220 of SEQ ID NO: 10 (MtncADH D220C) Engineered to asparagine
MSSSSDSFSSLTLNIGIVGFGTFGQFLAKTMIQQGHTISATSRTDYSQLCHQLGISFFRDVAAFVEADNDVILISTSILSLSKMLKSIPFRCLKRRTLFVDVLSVKEHPRDVLLQVLPEEMDLLCTHPMFGPESGKSGWEDLVLMYDKVRVRDEATCSSFLRIFERQGCRMMQMSCEEHDRLAARSQFLTHAIGRILSETGIESTSINTKSFETLVKLKESTTNNSFDLFSGLFIHNRFAKQELMNLEHAFQMVKKKLLQTANEEQIPNKSNHQMDSC

SEQ ID NO: 29 - protein, 278 aa, Artificial Sequence
  Synthetic: Tcacao1EG010641t1 - amino acid residue at a position corresponding to amino acid residue 220 of SEQ ID NO: 10 (MtncADH D220C) Engineered to cysteine
MSSSSDSFSSLTLNIGIVGFGTFGQFLAKTMIQQGHTISATSRTDYSQLCHQLGISFFRDVAAFVEADNDVILISTSILSLSKMLKSIPFRCLKRRTLFVDVLSVKEHPRDVLLQVLPEEMDLLCTHPMFGPESGKSGWEDLVLMYDKVRVRDEATCSSFLRIFERQGCRMMQMSCEEHDRLAARSQFLTHAIGRILSETGIESTSINTKSFETLVKLKESTTNCSFDLFSGLFIHNRFAKQELMNLEHAFQMVKKKLLQTANEEQIPNKSNHQMDSC

SEQ ID NO: 30 - protein, 371 aa, Artificial Sequence
  Synthetic: Graimondii09g126800.1 - amino acid residue at a position corresponding to amino acid residue 220 of SEQ ID NO: 10 (MtncADH D220C) Engineered to asparagine
MLIFSPTTIRSVNPQPLPYLSFSHSISLPLPLTSLPTPSKSPHFPSFHINCIDAAQPFDYESHLKNRYIQSTSLKIAIIGFGNFGQFLSKTFLRHHTLLAHSRTNYADLANHLGVSFYADPHDLFEQHPDVVLLSTSILSTETLLQKLPFQRLRRNTLFVDVLSVKEFPRNLFLKYLPPDFDILCTHPMFGPESGKTSWAGLPFVYDKVRIGDEESRIKRCDKFLDIFEKEGCRMVEMSCMEHDKYAAGSQFVTHTMGRVLEKFGLESSPINTKGYETLLNLVENTKGNSFDLYYGLFMYNQNALEQLERLDMAFESIKKDLFGRLHQVYRKQLFGDNNGEVEKKRSLAQQLLGNGSLTESPLDNVRQDGS

SEQ ID NO: 31 - protein, 371 aa, Artificial Sequence
  Synthetic: Graimondii09g126800.1 - amino acid residue at a position corresponding to amino acid residue 220 of SEQ ID NO: 10 (MtncADH D220C) Engineered to cysteine
MLIFSPTTIRSVNPQPLPYLSFSHSISLPLPLTSLPTPSKSPHFPSFHINCIDAAQPFDYESHLKNRYIQSTSLKIAIIGFGNFGQFLSKTFLRHHTLLAHSRTNYADLANHLGVSFYADPHDLFEQHPDVVLLSTSILSTETLLQKLPFQRLRRNTLFVDVLSVKEFPRNLFLKYLPPDFDILCTHPMFGPESGKTSWAGLPFVYDKVRIGDEESRIKRCDKFLDIFEKEGCRMVEMSCMEHDKYAAGSQFVTHTMGRVLEKFGLESSPINTKGYETLLNLVENTKGCSFDLYYGLFMYNQNALEQLERLDMAFESIKKDLFGRLHQVYRKQLFGDNNGEVEKKRSLAQQLLGNGSLTESPLDNVRQDGS

SEQ ID NO: 32 - protein, 468 aa, Artificial Sequence
  Synthetic: Tcacao1EG027290t1 - amino acid residue at a position corresponding to amino acid residue 220 of SEQ ID NO: 10 (MtncADH D220C) Engineered to asparagine
MIKKNEDATFLPSVHLHLTKLLLVGGLEPNLTNLQKKKVKVVEPQPTTSDSKLGPQREGKIKSPLKYSIPQLGEANGNTIFESVHCLPQFCVKFRILRMLLFSATRPLNPPQPLPFLSFSRFVSLSLPLPILPNPSRSTHFPSLQIYSIDAAQPFDYESHLKNRYLQSTSLKIAIIGFGNFGQFLSETFIRHHHTLLAHSRTNYTNLANQLGVSFFSDPNDLFEQHPDVVLLSTSILSTETLLQQLPFQRLRRNTLFVDVLSVKEFPRNLFLKYLPPDFDILCTHPMFGPESGKNTWAGLPFVYDKVRIGDEESRVKRCEKFLDIFEKEGCRMVEMSCMEHDKYAAGSQFVTHTMGRVLEQFGLESSPINTKGYETLLNLVENTKGNSFDLYYGLFMYNQNALEQLERLDMAFESIKKELFGRLHRVYRKQLFGDKEEKERERRFAQKLLGNGGLIDPPLDNVGQDGS

SEQ ID NO: 33 - protein, 468 aa, Artificial Sequence
  Synthetic: Tcacao1EG027290t1 - amino acid residue at a position corresponding to amino acid residue 220 of SEQ ID NO: 10 (MtncADH D220C) Engineered to cysteine
MIKKNEDATFLPSVHLHLTKLLLVGGLEPNLTNLQKKKVKVVEPQPTTSDSKLGPQREGKIKSPLKYSIPQLGEANGNTIFESVHCLPQFCVKFRILRMLLFSATRPLNPPQPLPFLSFSRFVSLSLPLPILPNPSRSTHFPSLQIYSIDAAQPFDYESHLKNRYLQSTSLKIAIIGFGNFGQFLSETFIRHHHTLLAHSRTNYTNLANQLGVSFFSDPNDLFEQHPDVVLLSTSILSTETLLQQLPFQRLRRNTLFVDVLSVKEFPRNLFLKYLPPDFDILCTHPMFGPESGKNTWAGLPFVYDKVRIGDEESRVKRCEKFLDIFEKEGCRMVEMSCMEHDKYAAGSQFVTHTMGRVLEQFGLESSPINTKGYETLLNLVENTKGCSFDLYYGLFMYNQNALEQLERLDMAFESIKKELFGRLHRVYRKQLFGDKEEKERERRFAQKLLGNGGLIDPPLDNVGQDGS

SEQ ID NO: 34 - protein, 377 aa, Artificial Sequence
  Synthetic: Slycopersicum07g007590 - amino acid residue at a position corresponding to amino acid residue 220 of SEQ ID NO: 10 (MtncADH D220C) Engineered to asparagine
MLSFTPLQSKPTPTSNSNRFSNLTNPTSSTSRRRHFSVSSPSQVSHHHGRRRLSIKAIDAAQPYDYEALVSNQYAQSGRLKIAIVGFGNFGQFLAKSFVSKGHFVLAHSRTDYSQIAISLGVSFFQDPHDLCEQHPDVIVLCTSIISTETVLRSLPIQRLKRNTLFVDVLSVKEFPKNIFLQVLPTHFDILCTHPMFGPESGKDSWKDLIFMFDKVRIGEGRSRTARVDKFLDIFEKEGCRMVPMTCAEHDKHAAGSQFITHTMGRVLEKLGLESTPINTKGYETLLNLVDNTASNSFDLYYGLFMYNKNAMEELERLDLAFEALKKELFGHLHDLLRKQLFGKAEEAGQRRVLSKLPRNGYALPAPSSDAVKPENN

SEQ ID NO: 35 - protein, 377 aa, Artificial Sequence
  Synthetic: Slycopersicum07g007590 - amino acid residue at a position corresponding to amino acid residue 220 of SEQ ID NO: 10 (MtncADH D220C) Engineered to cysteine
MLSFTPLQSKPTPTSNSNRFSNLTNPTSSTSRRRHFSVSSPSQVSHHHGRRRLSIKAIDAAQPYDYEALVSNQYAQSGRLKIAIVGFGNFGQFLAKSFVSKGHFVLAHSRTDYSQIAISLGVSFFQDPHDLCEQHPDVIVLCTSIISTETVLRSLPIQRLKRNTLFVDVLSVKEFPKNIFLQVLPTHFDILCTHPMFGPESGKDSWKDLIFMFDKVRIGEGRSRTARVDKFLDIFEKEGCRMVPMTCAEHDKHAAGSQFITHTMGRVLEKLGLESTPINTKGYETLLNLVDNTASCSFDLYYGLFMYNKNAMEELERLDLAFEALKKELFGHLHDLLRKQLFGKAEEAGQRRVLSKLPRNGYALPAPSSDAVKPENN

SEQ ID NO: 36 - protein, 391 aa, Artificial Sequence
  Synthetic: Slycopersicum09g011870 - amino acid residue at a position corresponding to amino acid residue 220 of SEQ ID NO: 10 (MtncADH D220C) Engineered to asparagine
MFSLSSIQSNNIQSQSSSSLLFNHHHQHSTISTRFHHHRLLFPLRAQNSDLTTATTNNNYVDLDDNLTRLDKFSKSLSISNIEENTSLNPLLCSNNKLKIAIIGFGNFGQFIAKSFIKQGHVVLAHSRSDYSLIAQSLNVHFFQDPNDLCEQHPDVILLCTSINSLENVIRSLPIQKLKRNTLFVDVLSVKEFPKNIFLQASLPKEFDILCTHPMFGPTSGKDNWKGLPFMYDKVRIGQEESRIKRVNNFINIFVKEGCRMVEMSCSEHDKYAAGSQFITHTIGRMLQRLGTQTTPINTKGYESLLNLMENTTSNSFDLYCGLFMYNNNSMEVLEKLDAALDSLKRELFGQVLQKLEKRVEKGSRLALPTPDFSKKIEKLKVERKELEALS

SEQ ID NO: 37 - protein, 391 aa, Artificial Sequence
  Synthetic: Slycopersicum09g011870 - amino acid residue at a position corresponding to amino acid residue 220 of SEQ ID NO: 10 (MtncADH D220C) Engineered to cysteine
MFSLSSIQSNNIQSQSSSSLLFNHHHQHSTISTRFHHHRLLFPLRAQNSDLTTATTNNNYVDLDDNLTRLDKFSKSLSISNIEENTSLNPLLCSNNKLKIAIIGFGNFGQFIAKSFIKQGHVVLAHSRSDYSLIAQSLNVHFFQDPNDLCEQHPDVILLCTSINSLENVIRSLPIQKLKRNTLFVDVLSVKEFPKNIFLQASLPKEFDILCTHPMFGPTSGKDNWKGLPFMYDKVRIGQEESRIKRVNNFINIFVKEGCRMVEMSCSEHDKYAAGSQFITHTIGRMLQRLGTQTTPINTKGYESLLNLMENTTSCSFDLYCGLFMYNNNSMEVLEKLDAALDSLKRELFGQVLQKLEKRVEKGSRLALPTPDFSKKIEKLKVERKELEALS

SEQ ID NO: 38 - protein, 654 aa, Artificial Sequence
  Synthetic: Fvesca17779 - amino acid residue at a position corresponding to amino acid residue 220 of SEQ ID NO: 10 (MtncADH D220C) Engineered to asparagine
MSLRGLLMASTFEKTTHINPSITSSSDEAGYTCKCNQHSSSMVITVVAVTQNSEFLTEFHNVQMLKIAIIGFGNLGQSLAKTFAHLGHIVLAHSRCEHSKMAQDLGISYFSNPQELCEQNPQVILLCTSIISTESVLKSLPLQSLTHDTLFVDMLPVKEFSKALLLKMLPSNLAVVCTNPMFGVERGKHEWNGSFLVYEKVRIGSDSVGISLCDNFLNIFEKEGCRMVEVSCSVQDKYVAGSQFITHTVGRVLEKLTLESTPINTKGYETLLDLVDNTAGNSFDLYCELFIYNKNAFEMFDRLDLAFNTLKKQLFGHLHDIVRKQLFDSAEKVHAEYMVCNPSHNGAALRSHSQVLNQKAHISEHYDDKSMLKIAIVGFGNFGQFLAKTIIRQGHKVLAYSRSDYYDVAQEMGVIYLSDVEALCEEHPEVMLFCTSILSTEKVLRSFPVQRLMRNTLFVDVLSVKEFPRNLFLQKLPLDFDILCTHPMFGPESGKNGWNALPFVYDKVRVGSDKSRVSLCDRFLDIFALEGCRMVEMSCSEHDRHAAGSQFITHTIGRVLEKLGLESTPILPNGYKALLNLVENTVGNSFDLYHGLFMYNVNAIDQLNRLDMAFNSLKEQFLRRLHGVVHSQHFENASRTLLPNHPENAAPLRR

SEQ ID NO: 39 - protein, 654 aa, Artificial Sequence
  Synthetic: Fvesca17779 - amino acid residue at a position corresponding to amino acid residue 220 of SEQ ID NO: 10 (MtncADH D220C) Engineered to cysteine
MSLRGLLMASTFEKTTHINPSITSSSDEAGYTCKCNQHSSSMVITVVAVTQNSEFLTEFHNVQMLKIAIIGFGNLGQSLAKTFAHLGHIVLAHSRCEHSKMAQDLGISYFSNPQELCEQNPQVILLCTSIISTESVLKSLPLQSLTHDTLFVDMLPVKEFSKALLLKMLPSNLAVVCTNPMFGVERGKHEWNGSFLVYEKVRIGSDSVGISLCDNFLNIFEKEGCRMVEVSCSVQDKYVAGSQFITHTVGRVLEKLTLESTPINTKGYETLLDLVDNTAGCSFDLYCELFIYNKNAFEMFDRLDLAFNTLKKQLFGHLHDIVRKQLFDSAEKVHAEYMVCNPSHNGAALRSHSQVLNQKAHISEHYDDKSMLKIAIVGFGNFGQFLAKTIIRQGHKVLAYSRSDYYDVAQEMGVIYLSDVEALCEEHPEVMLFCTSILSTEKVLRSFPVQRLMRNTLFVDVLSVKEFPRNLFLQKLPLDFDILCTHPMFGPESGKNGWNALPFVYDKVRVGSDKSRVSLCDRFLDIFALEGCRMVEMSCSEHDRHAAGSQFITHTIGRVLEKLGLESTPILPNGYKALLNLVENTVGCSFDLYHGLFMYNVNAIDQLNRLDMAFNSLKEQFLRRLHGVVHSQHFENASRTLLPNHPENAAPLRR

SEQ ID NO: 40 - protein, 640 aa, Artificial Sequence
  Synthetic: Athaliana5g34930.1 - amino acid residue at a position corresponding to amino acid residue 220 of SEQ ID NO: 10 (MtncADH D220C) Engineered to asparagine
MAETLITKPPLSLSFTSLSSMLPSLSLSTANRHLSVTDTIPLPNSNSNATPPLRIAIIGFGNYGQFLAETLISQGHILFAHSRSDHSSAARRLGVSYFTDLHDLCERHPDVVLLCTSILSIENILKTLPFQRLRRNTLFVDVLSVKEFAKTLLLQYLPEDFDILCTHPMFGPQSVSSNHGWRGLRFVYDKVRIGEERLRVSRCESFLEIFVREGCEMVEMSVTDHDKFAAESQFITHTLGRLLGMLKLISTPINTKGYEALLDLAENICGNSFDLYYGLFVYNNNSLEVLERIDLAFEALRKELFSRLHGVVRKQSFEGEAKKVHVFPNCGENDASLDMMRSEDVVVKYEYNSQVSGSVNDGSRLKIGIVGFGNFGQFLGKTMVKQGHTVLAYSRSDYTDEAAKLGVSYFSDLDDLFEEHPEVIILCTSILSTEKVLESLPFQRLKRSTLFVDVLSVKEFPRNLFLQTLPQDFDILCTHPMFGPESGKNGWNNLAFVFDKVRIGMDDRRKSRCNSFLDIFAREGCRMVEMSCAEHDWHAAGSQFITHTVGRLLEKLSLESTPIDTKGYETLLKLVENTAGNSFDLYYGLFLYNPNAMEQLERFHVAFESLKTQLFGRLHSQHSHELAKSSSPKTTKLLTS

SEQ ID NO: 41 - protein, 640 aa, Artificial Sequence
  Synthetic: Athaliana5g34930.1 - amino acid residue at a position corresponding to amino acid residue 220 of SEQ ID NO: 10 (MtncADH D220C) Engineered to cysteine
MAETLITKPPLSLSFTSLSSMLPSLSLSTANRHLSVTDTIPLPNSNSNATPPLRIAIIGFGNYGQFLAETLISQGHILFAHSRSDHSSAARRLGVSYFTDLHDLCERHPDVVLLCTSILSIENILKTLPFQRLRRNTLFVDVLSVKEFAKTLLLQYLPEDFDILCTHPMFGPQSVSSNHGWRGLRFVYDKVRIGEERLRVSRCESFLEIFVREGCEMVEMSVTDHDKFAAESQFITHTLGRLLGMLKLISTPINTKGYEALLDLAENICGCSFDLYYGLFVYNNNSLEVLERIDLAFEALRKELFSRLHGVVRKQSFEGEAKKVHVFPNCGENDASLDMMRSEDVVVKYEYNSQVSGSVNDGSRLKIGIVGFGNFGQFLGKTMVKQGHTVLAYSRSDYTDEAAKLGVSYFSDLDDLFEEHPEVIILCTSILSTEKVLESLPFQRLKRSTLFVDVLSVKEFPRNLFLQTLPQDFDILCTHPMFGPESGKNGWNNLAFVFDKVRIGMDDRRKSRCNSFLDIFAREGCRMVEMSCAEHDWHAAGSQFITHTVGRLLEKLSLESTPIDTKGYETLLKLVENTAGCSFDLYYGLFLYNPNAMEQLERFHVAFESLKTQLFGRLHSQHSHELAKSSSPKTTKLLTS

SEQ ID NO: 42 - protein, 680 aa, Artificial Sequence
  Synthetic: Fvesca30772 - amino acid residue at a position corresponding to amino acid residue 220 of SEQ ID NO: 10 (MtncADH D220C) Engineered to asparagine
MPPLSLHPFPPKLIPTPSLLFNPQSPNLYPQSSHLYYHTPNSTPKRRRFGLQIKSLDAAQVFDYESKLAAQFRSSQTLTIAIIGFGNFGQFLAKTLTRQGHTVLAHSRSDHSAAAAKLGVSFFPDPHDLCEQHPHVILLCTSIISAAAVLSSLPVQRLRRSTLFADVLSVKEFSKALFLNALPPYFDLICTHPMFGPESAKESWNELHFVFEKVRIGEEGSRAERCEKFLSIFEREGCKMVEMSCVEHDKYAAGSQFITHTVGRVLGMLRLESTPINTKGYETLLDLVENTAGNSFDLYYGLFVYNKNALDMLERLDSAFEALKAQLFGRLHDVVRNQLFGNAGKVRPLQEENVNQNGAALVRSSIAGRPLKVHVLDSSGDDNSMLRVGIVGFGNFGQFLAKTIVRQGHKVLAYSRSDYSDVARLLGVSYFSDADDFCEEHPEVIILCTSILSTEKVLMSLPLQRLKRSTLFVDVLSVKEFPRSLFLQRLPPYFDILCTHPMFGPESGKNGWNGLAFVYDRVRIGNEESRVSRCDQFLDIFAQEGCRMVQMSCEEHDKHAAGSQFITHTMGRILEKLGLESTPVNTKGYKTLLNLVENTAGNSFDLYYGLFMYNANAMEQLKRLDNAFEALKKQLFGRLHGVSRKQIFENEDDSQHLLPTPSENESASTSSLEALNIQNN

SEQ ID NO: 43 - protein, 680 aa, Artificial Sequence
  Synthetic: Fvesca30772 - amino acid residue at a position corresponding to amino acid residue 220 of SEQ ID NO: 10 (MtncADH D220C) Engineered to cysteine
MPPLSLHPFPPKLIPTPSLLFNPQSPNLYPQSSHLYYHTPNSTPKRRRFGLQIKSLDAAQVFDYESKLAAQFRSSQTLTIAIIGFGNFGQFLAKTLTRQGHTVLAHSRSDHSAAAAKLGVSFFPDPHDLCEQHPHVILLCTSIISAAAVLSSLPVQRLRRSTLFADVLSVKEFSKALFLNALPPYFDLICTHPMFGPESAKESWNELHFVFEKVRIGEEGSRAERCEKFLSIFEREGCKMVEMSCVEHDKYAAGSQFITHTVGRVLGMLRLESTPINTKGYETLLDLVENTAGCSFDLYYGLFVYNKNALDMLERLDSAFEALKAQLFGRLHDVVRNQLFGNAGKVRPLQEENVNQNGAALVRSSIAGRPLKVHVLDSSGDDNSMLRVGIVGFGNFGQFLAKTIVRQGHKVLAYSRSDYSDVARLLGVSYFSDADDFCEEHPEVIILCTSILSTEKVLMSLPLQRLKRSTLFVDVLSVKEFPRSLFLQRLPPYFDILCTHPMFGPESGKNGWNGLAFVYDRVRIGNEESRVSRCDQFLDIFAQEGCRMVQMSCEEHDKHAAGSQFITHTMGRILEKLGLESTPVNTKGYKTLLNLVENTAGCSFDLYYGLFMYNANAMEQLKRLDNAFEALKKQLFGRLHGVSRKQIFENEDDSQHLLPTPSENESASTSSLEALNIQNN

SEQ ID NO: 44 - protein, 682 aa, Artificial Sequence
  Synthetic: Graimondii10g059700.1 - amino acid residue at a position corresponding to amino acid residue 220 of SEQ ID NO: 10 (MtncADH D220C) Engineered to asparagine
MITHPCLHPSLSKPSLSFLSSSSPPFLQHLSFLPTSPSVTKPVFVHSVKPLHVKCSSTNPTSQSHPDHAPPISTLKIAIIGFGNYGQFLAKTLVSQGHIVLAHSRSDYSHVAKKLGVSFFLNPHDLCEQHPEVILLCTSIISTEQVLKTLPLQRLKRSTLFVDVLSVKEFARNLLLDALPLDFDIICSHPMFGPQSAKQSWKDLFFVYEKVRIGNESSRVQRCEQFLEIFQSEGCKMVEMSCQEHDKLAAGSQFMTHTVGRVLDMLGLESTPINTKGYETLLDLVENTCRNSFDLYYGLFLYNKSALEMVERLDLAFDALRNELFGRLHHVVRKQFFENGEKVKSVHDSSYQNGAASAFSSNALRSQDVTIPYEFKGKILESVDDSSKLKVAIVGFGNFGQFLAKTLARQGHSVLAYSRTDYRDAAQKLGVSFFSDANDLCEEHPEVILLCTSILSTEKVLKSLPFQRLKRSTLFVDVLSVKEFPRNLFLQHLPPEFDILCTHPMFGPESGKNGWNELPFVFDKVRIGNDERRVARCNSFLDIFAREGCRMVEMTCAEHDWHAAGSQFITHTMGRVLEKLQLESTPINTKGYETLLNLVENTAGNSFDLYYGLFMYNVNAMEQLERMDFAFESLKKQLFGRLHGVLRKELFGDSEKLEVLQEKSVRKNGAALSSSPESVKIS

SEQ ID NO: 45 - protein, 682 aa, Artificial Sequence
  Synthetic: Graimondii10g059700.1 - amino acid residue at a position corresponding to amino acid residue 220 of SEQ ID NO: 10 (MtncADH D220C) Engineered to cysteine
MITHPCLHPSLSKPSLSFLSSSSPPFLQHLSFLPTSPSVTKPVFVHSVKPLHVKCSSTNPTSQSHPDHAPPISTLKIAIIGFGNYGQFLAKTLVSQGHIVLAHSRSDYSHVAKKLGVSFFLNPHDLCEQHPEVILLCTSIISTEQVLKTLPLQRLKRSTLFVDVLSVKEFARNLLLDALPLDFDIICSHPMFGPQSAKQSWKDLFFVYEKVRIGNESSRVQRCEQFLEIFQSEGCKMVEMSCQEHDKLAAGSQFMTHTVGRVLDMLGLESTPINTKGYETLLDLVENTCRCSFDLYYGLFLYNKSALEMVERLDLAFDALRNELFGRLHHVVRKQFFENGEKVKSVHDSSYQNGAASAFSSNALRSQDVTIPYEFKGKILESVDDSSKLKVAIVGFGNFGQFLAKTLARQGHSVLAYSRTDYRDAAQKLGVSFFSDANDLCEEHPEVILLCTSILSTEKVLKSLPFQRLKRSTLFVDVLSVKEFPRNLFLQHLPPEFDILCTHPMFGPESGKNGWNELPFVFDKVRIGNDERRVARCNSFLDIFAREGCRMVEMTCAEHDWHAAGSQFITHTMGRVLEKLQLESTPINTKGYETLLNLVENTAGCSFDLYYGLFMYNVNAMEQLERMDFAFESLKKQLFGRLHGVLRKELFGDSEKLEVLQEKSVRKNGAALSSSPESVKIS

SEQ ID NO: 46 - protein, 734 aa, Artificial Sequence
  Synthetic: Tcacao1EG038186t1 - amino acid residue at a position corresponding to amino acid residue 220 of SEQ ID NO: 10 (MtncADH D220C) Engineered to asparagine
MAMPSLSFLHQSPPKPSHVYFCNPSPPPLFLQSPSFVYMTTPLSLHSSKALQIRSSFSSTSTSEPTQDPVRLAFSVNSTLKIAIIGFGNYGQHLAKTLVAQGHSLLAYSRSDHSHIAQELGVSFFLNPSDLCEQHPDVILLCTSIISTEQVLKSLPLKRLKRSTLFVDVLSVKEFAKNLLLDVLPPDFDIICSHPMFGPQSAKQSWENLFFMYEKVRIGNESSRVQRCNDFLAIFEREGCKMVEMSCQEHDKLAAGSQFMTHTVGRVLDMLGLESTPINTKGYETLLELVENTRGNSFDLYYGLFLYNKSALEMLEKLDLGFDELRNELSGRLHDVVKKQLFENAARGKSLQDKSYQNSAGMASILNSLRSQDAIQPYEYKEKISESIDDSSKLKIAIVGFGNFGQFLAKAFVRQGHSVLAYSRTDYCAVAQKLGVSFFSDADDLCEEHPDVILLCTSILSTEKVLNSLPLQRLKRSTLFVDVLSVKEFPRNLFLQNLPSDFDILCTHPMFGPESGKNGWKDLAFVFDKVRVGSDEKRVARCNRVLDVFAREGCRMVEMSCAEHDWHAAGSQFITHTMGRVLEKLKLESTPINTKGYETLLNLVENTAGNSFDLYYGLFMYNVNALEQLEKLDLAFESLKKQLFGRLHGLFQRQLVGNADEKLQVLQNGKGKVFPEKSVVPYGAAMPASPKEKFHVLWENSVLQASPENRLEVVEEKSVRRNGAALATSPESVS

SEQ ID NO: 47 - protein, 734 aa, Artificial Sequence
  Synthetic: Tcacao1EG038186t1 - amino acid residue at a position corresponding to amino acid residue 220 of SEQ ID NO: 10 (MtncADH D220C) Engineered to cysteine
MAMPSLSFLHQSPPKPSHVYFCNPSPPPLFLQSPSFVYMTTPLSLHSSKALQIRSSFSSTSTSEPTQDPVRLAFSVNSTLKIAIIGFGNYGQHLAKTLVAQGHSLLAYSRSDHSHIAQELGVSFFLNPSDLCEQHPDVILLCTSIISTEQVLKSLPLKRLKRSTLFVDVLSVKEFAKNLLLDVLPPDFDIICSHPMFGPQSAKQSWENLFFMYEKVRIGNESSRVQRCNDFLAIFEREGCKMVEMSCQEHDKLAAGSQFMTHTVGRVLDMLGLESTPINTKGYETLLELVENTRGCSFDLYYGLFLYNKSALEMLEKLDLGFDELRNELSGRLHDVVKKQLFENAARGKSLQDKSYQNSAGMASILNSLRSQDAIQPYEYKEKISESIDDSSKLKIAIVGFGNFGQFLAKAFVRQGHSVLAYSRTDYCAVAQKLGVSFFSDADDLCEEHPDVILLCTSILSTEKVLNSLPLQRLKRSTLFVDVLSVKEFPRNLFLQNLPSDFDILCTHPMFGPESGKNGWKDLAFVFDKVRVGSDEKRVARCNRVLDVFAREGCRMVEMSCAEHDWHAAGSQFITHTMGRVLEKLKLESTPINTKGYETLLNLVENTAGCSFDLYYGLFMYNVNALEQLEKLDLAFESLKKQLFGRLHGLFQRQLVGNADEKLQVLQNGKGKVFPEKSVVPYGAAMPASPKEKFHVLWENSVLQASPENRLEVVEEKSVRRNGAALATSPESVS

SEQ ID NO: 48 - protein, 690 aa, Artificial Sequence
  Synthetic: Gmax17g13151 - amino acid residue at a position corresponding to amino acid residue 220 of SEQ ID NO: 10 (MtncADH D220C) Engineered to asparagine
MAVSTFQAPPLKPSLPSTLLRRLKRVPLSHSFSLFSAPNTNSFHSSYRALRIRAIDAAQPFDYESRMAQQFHDAQKLKIAIVGFGNFGQFLAQTLVRQGHTILAHSRSDHSLSAQQLGVTFFQNPHDLCEEHPEVILLCSSIISTQRVLLTLPLQRLKRSTLFVDVLSVKEFPKNLLLHALPPDFDVLCTHPMFGPQSAPRAWTGLPFVYEKVRIGAHDDRRIARCEKFLGIFAREGCRMVEMSCADHDKLAAGSQFITHTVGRVLEMLTVKSTPINTKGYESLLNLVENTCGNSFDLFYGLFMYNKNSLEMLERLDFAFEDLRKQLMARLHDVVREHLSDNAGIGKVQSLPDEYVHQLLLKNGQNGSAAAPLLSLPSEDLRSGDVVKLNNYKSNDANQSDDNSKLKIAIVGFGNFGQFLAKTFVRHGHRVLAYSRSDYSLVAQELGVSYFNNIDDLCEQHPEVILLCTSILSTEKVLKSLPVQRLKRSTLFVDVLSVKEFPRNLFLQHLPRNFDILCTHPMFGPESGKNGWNGLAFVFDKVRIGIDESRSSRCDQFLDIFASEGCRMVEMSCAEHDWHAAGSQFITHTTGRFLEKLELEGTPIDTKGYETLLSLVENTAGNSFDLYYGLFLYNRNAMEQLERFDLAFESVKKQLFDRLHGFYRQQVFKHEEKLHDSPERRMLPKISEDK

SEQ ID NO: 49 - protein, 690 aa, Artificial Sequence
  Synthetic: Gmax17g13151 - amino acid residue at a position corresponding to amino acid residue 220 of SEQ ID NO: 10 (MtncADH D220C) Engineered to cysteine
MAVSTFQAPPLKPSLPSTLLRRLKRVPLSHSFSLFSAPNTNSFHSSYRALRIRAIDAAQPFDYESRMAQQFHDAQKLKIAIVGFGNFGQFLAQTLVRQGHTILAHSRSDHSLSAQQLGVTFFQNPHDLCEEHPEVILLCSSIISTQRVLLTLPLQRLKRSTLFVDVLSVKEFPKNLLLHALPPDFDVLCTHPMFGPQSAPRAWTGLPFVYEKVRIGAHDDRRIARCEKFLGIFAREGCRMVEMSCADHDKLAAGSQFITHTVGRVLEMLTVKSTPINTKGYESLLNLVENTCGCSFDLFYGLFMYNKNSLEMLERLDFAFEDLRKQLMARLHDVVREHLSDNAGIGKVQSLPDEYVHQLLLKNGQNGSAAAPLLSLPSEDLRSGDVVKLNNYKSNDANQSDDNSKLKIAIVGFGNFGQFLAKTFVRHGHRVLAYSRSDYSLVAQELGVSYFNNIDDLCEQHPEVILLCTSILSTEKVLKSLPVQRLKRSTLFVDVLSVKEFPRNLFLQHLPRNFDILCTHPMFGPESGKNGWNGLAFVFDKVRIGIDESRSSRCDQFLDIFASEGCRMVEMSCAEHDWHAAGSQFITHTTGRFLEKLELEGTPIDTKGYETLLSLVENTAGCSFDLYYGLFLYNRNAMEQLERFDLAFESVKKQLFDRLHGFYRQQVFKHEEKLHDSPERRMLPKISEDK

SEQ ID NO: 50 - protein, 685 aa, Artificial Sequence
  Synthetic: Gmax05g07870 - amino acid residue at a position corresponding to amino acid residue 220 of SEQ ID NO: 10 (MtncADH D220C) Engineered to asparagine
MAVSTFQAAPPKPTLGSSLLSRRMKHVPFSLSFFSAPKTISSYRPILRIRAIDAAQPFDYESRMAQQFHDSQKLKIAIVGFGNFGQFLAQTLVRQGHTVLAHSRSDHSLAAQQLGVTFFPNPHDLCEEHPEVILLCSSIISTQRVLLTLPLQRLKRSTLFVDVLSVKEFPKNLLLHALPSDFDVLCTHPMFGPQSAPRAWTGLPFVYEKVRIGSDEHRIARCEKFLGIFAREGCRMVEMSCADHDKFAAGSQFITHTVGRVLEMLTVESTPINTKGYESLLNLVENTSGNSFDLFYGLFMYNKNSLEMLERLDFAFEDLRKQLMGRLHDVVREQLFDNAGMGKVQSLPDEYVHQLLLKNGQNGSAAPVLSLPSNDLRSSDVVKLYNYKSNDANQSDDKTKLKIAIVGFGNFGQFLAKTFVRHGHQVLAYSRSDYSHVAQELGVSYFNNIDDLCEQHPEVILLCTSILSTEKVLKSLPVQRLKRSTLFVDVLSVKEFPRNLFLHHLPHNFDILCTHPMFGPESGKNGWNGLAFVYDKVRIGIDESRTSRCDQFLDIFASEGCRMVEMSCAEHDWHAAGSQFITHTTGRFLEKLELEGTPIDTKGYETLLSLVENTAGNSFDLYYGLFLYNINAMEQLERFDLAFESVKKELFDRLHGFYRQQVFKHEEKLHDLPERPMLSKISEDK

SEQ ID NO: 51 - protein, 685 aa, Artificial Sequence
  Synthetic: Gmax05g07870 - amino acid residue at a position corresponding to amino acid residue 220 of SEQ ID NO: 10 (MtncADH D220C) Engineered to cysteine
MAVSTFQAAPPKPTLGSSLLSRRMKHVPFSLSFFSAPKTISSYRPILRIRAIDAAQPFDYESRMAQQFHDSQKLKIAIVGFGNFGQFLAQTLVRQGHTVLAHSRSDHSLAAQQLGVTFFPNPHDLCEEHPEVILLCSSIISTQRVLLTLPLQRLKRSTLFVDVLSVKEFPKNLLLHALPSDFDVLCTHPMFGPQSAPRAWTGLPFVYEKVRIGSDEHRIARCEKFLGIFAREGCRMVEMSCADHDKFAAGSQFITHTVGRVLEMLTVESTPINTKGYESLLNLVENTSGCSFDLFYGLFMYNKNSLEMLERLDFAFEDLRKQLMGRLHDVVREQLFDNAGMGKVQSLPDEYVHQLLLKNGQNGSAAPVLSLPSNDLRSSDVVKLYNYKSNDANQSDDKTKLKIAIVGFGNFGQFLAKTFVRHGHQVLAYSRSDYSHVAQELGVSYFNNIDDLCEQHPEVILLCTSILSTEKVLKSLPVQRLKRSTLFVDVLSVKEFPRNLFLHHLPHNFDILCTHPMFGPESGKNGWNGLAFVYDKVRIGIDESRTSRCDQFLDIFASEGCRMVEMSCAEHDWHAAGSQFITHTTGRFLEKLELEGTPIDTKGYETLLSLVENTAGCSFDLYYGLFLYNINAMEQLERFDLAFESVKKELFDRLHGFYRQQVFKHEEKLHDLPERPMLSKISEDK

SEQ ID NO: 52 - protein, 690 aa, Artificial Sequence
  Synthetic: Mtruncatula4g115980 - amino acid residue at a position corresponding to amino acid residue 220 of SEQ ID NO: 10 (MtncADH D220C) Engineered to asparagine
MLGVSTFHSTSLKTPSHSTTTRLNPTFPFSISISPSFNRSTTTKPLTIRAIDAAQSFDYESKIALQFHNSQKLKIAIIGFGNFGQFLATTFVRQGHTVLAHSRSDYSAVAQNIGVKFFPNADDLCEEHPEVILLCTSIISAQQVLLSLPFQRLKRSTLFVDVLSVKEFPKNFFLEILPNYFDIICSHPMFGPESGSSGWKGLPFVYEKVRIGNNETRVSRCEKFLDVFGREGCRMVEMSCADHDRYAAGSQFITHTVGRVLGMLTLESTPINTKGYESLLNLVENTSGNSFDLYYGLFMFNKNSLEMLERLDLAFEDLRKQLIAHLHDVVRNQLFEDAVKVQNLGDDSNHVARKHGQNGSAIVLSSKNQRSADARLHGYYRSNGSGQSDDSTKLKIAIIGFGNFGQFLAKTIVRHGHKVLAYSRTDYSDVARELGVSYFNDADDLCEQHPEVILLCTSILSTEKVLKSLPVQRLRRSTLFVDVLSVKEFPRNLFLQHLPPYFDVLCTHPMFGPESGKNGWKGLPFLFDKVRVGRDESRISRCDLFLDIFSKEGCRMVEMSCAEHDWHAAGSQFITHTTGRFLEKLKLEATPIDTKGYETLLSLVENTGGNSFDLYYGLFLYNINAMEQLQRFDLAFESLKKQLFDRLHGIYRKQVFQNEEKVRDFPERSMLPEKSEDSSVVSFSNTVDAK

SEQ ID NO: 53 - protein, 690 aa, Artificial Sequence
  Synthetic: Mtruncatula4g115980 - amino acid residue at a position corresponding to amino acid residue 220 of SEQ ID NO: 10 (MtncADH D220C) Engineered to cysteine
MLGVSTFHSTSLKTPSHSTTTRLNPTFPFSISISPSFNRSTTTKPLTIRAIDAAQSFDYESKIALQFHNSQKLKIAIIGFGNFGQFLATTFVRQGHTVLAHSRSDYSAVAQNIGVKFFPNADDLCEEHPEVILLCTSIISAQQVLLSLPFQRLKRSTLFVDVLSVKEFPKNFFLEILPNYFDIICSHPMFGPESGSSGWKGLPFVYEKVRIGNNETRVSRCEKFLDVFGREGCRMVEMSCADHDRYAAGSQFITHTVGRVLGMLTLESTPINTKGYESLLNLVENTSGCSFDLYYGLFMFNKNSLEMLERLDLAFEDLRKQLIAHLHDVVRNQLFEDAVKVQNLGDDSNHVARKHGQNGSAIVLSSKNQRSADARLHGYYRSNGSGQSDDSTKLKIAIIGFGNFGQFLAKTIVRHGHKVLAYSRTDYSDVARELGVSYFNDADDLCEQHPEVILLCTSILSTEKVLKSLPVQRLRRSTLFVDVLSVKEFPRNLFLQHLPPYFDVLCTHPMFGPESGKNGWKGLPFLFDKVRVGRDESRISRCDLFLDIFSKEGCRMVEMSCAEHDWHAAGSQFITHTTGRFLEKLKLEATPIDTKGYETLLSLVENTGGCSFDLYYGLFLYNINAMEQLQRFDLAFESLKKQLFDRLHGIYRKQVFQNEEKVRDFPERSMLPEKSEDSSVVSFSNTVDAK

SEQ ID NO: 54 - protein, 731 aa, Artificial Sequence
  Synthetic: Pvulgaris03g178200 - amino acid residue at a position corresponding to amino acid residue 220 of SEQ ID NO: 10 (MtncADH D220C) Engineered to asparagine
MVAVSTFQAPSLPKASTSLSSTIICGNLKLNFLPFSSPKAFSSGVRVHRPLRIRAIDAAQPFDYESRVAQQFHDAQRLKIAIVGFGNYGQFLAQTLVRQGHTVLAHSRSDYTDAARKLGVTFFHNPHDLCEEHPEVILLCSSIISTQRVLLTLPLQSLKRSTLFVDVLSVKEFPKNLLLHALPSDFDILCTHPMFGPQSAPRAWAGLPFVFEKVRIGDDDRRIERCDKFLNIFAREGCRMVEMCCADHDMFAAGSQFITHTVGRVLEMLMLESTPINTKGYESLFNLVENTAGNSFDLYYGLFMFNKNSLEMLERLDFAFEDLRKQLMGRLHGVVRQQLFDNAGIGKGQSLPDDYVYKLLKKAQNGSAPVLSLPSKEHRSDDVAKLDKYNTNDSSQSADNSKLMNALNGFAPVLSRVSKELRFIDVTELNKYKPNISSQSEDSTKLKIAIIGFGNFGQFLAKSIVRQGHKVLAYSRSDYSRVAEEMGASYFNNVDDLFEQHPEVILLCTSILSTEKVLKSLPVQRLKRSTLFVDVLSVKEFPRNLFLQHLSHDFDILCTHPMFGPESGKNGWNGLAFVYDKVRIGTDESRTSRCDRFLDIFSREGCRMVEMSCAEHDWHAAGSQFITHTTGRFLEKLKLEATPIDTKGYETLLSLVENTAGNSFDLYYGLFLYNANAMEQLERFDLAFESLKKRLFDRMHAFYRQQVFEHEEEKLQNLSERRMLPKGSEEK

SEQ ID NO: 55 - protein, 731 aa, Artificial Sequence
  Synthetic: Pvulgaris03g178200 - amino acid residue at a position corresponding to amino acid residue 220 of SEQ ID NO: 10 (MtncADH D220C) Engineered to cysteine
MVAVSTFQAPSLPKASTSLSSTIICGNLKLNFLPFSSPKAFSSGVRVHRPLRIRAIDAAQPFDYESRVAQQFHDAQRLKIAIVGFGNYGQFLAQTLVRQGHTVLAHSRSDYTDAARKLGVTFFHNPHDLCEEHPEVILLCSSIISTQRVLLTLPLQSLKRSTLFVDVLSVKEFPKNLLLHALPSDFDILCTHPMFGPQSAPRAWAGLPFVFEKVRIGDDDRRIERCDKFLNIFAREGCRMVEMCCADHDMFAAGSQFITHTVGRVLEMLMLESTPINTKGYESLFNLVENTAGCSFDLYYGLFMFNKNSLEMLERLDFAFEDLRKQLMGRLHGVVRQQLFDNAGIGKGQSLPDDYVYKLLKKAQNGSAPVLSLPSKEHRSDDVAKLDKYNTNDSSQSADNSKLMNALNGFAPVLSRVSKELRFIDVTELNKYKPNISSQSEDSTKLKIAIIGFGNFGQFLAKSIVRQGHKVLAYSRSDYSRVAEEMGASYFNNVDDLFEQHPEVILLCTSILSTEKVLKSLPVQRLKRSTLFVDVLSVKEFPRNLFLQHLSHDFDILCTHPMFGPESGKNGWNGLAFVYDKVRIGTDESRTSRCDRFLDIFSREGCRMVEMSCAEHDWHAAGSQFITHTTGRFLEKLKLEATPIDTKGYETLLSLVENTAGCSFDLYYGLFLYNANAMEQLERFDLAFESLKKRLFDRMHAFYRQQVFEHEEEKLQNLSERRMLPKGSEEK

SEQ ID NO: 56 - DNA, 1134 bp, Solanum lycopersicum
  misc_feature (1)..(1134): Solyc07g007590.1
atgttgtctttcaccccacttcaatccaagccaaccccaacttccaattctaatcgtttctctaatctcaccaaccccactagcagtaccagccgccgccggcatttctctgtctcttctccgtcacaagtcagtcaccaccatggacgccgtcgtctgagtatcaaagctattgatgctgcacagccttatgattatgaagcattggtgtcaaatcaatatgctcagtcaggtaggctaaaaattgctatagtggggtttggcaattttggtcagtttcttgcaaaatcctttgttagtaaaggtcattttgtgttggctcattcaagaacagattattcccaaattgctatttctttaggggtttccttttttcaagatccacatgatctttgtgagcaacaccctgatgttattgtactttgtacttcgattatttcaactgagactgttcttaggtcattaccaattcaaaggctgaagaggaacacattgtttgttgatgttttatcagtcaaagaatttccaaaaaatatttttcttcaagttttgccaacccattttgatattctttgtactcatcccatgtttggacctgaaagtggtaaggatagttggaaagatttgatctttatgtttgacaaagttcgaattggtgaagggagatcaagaacagcaagggttgacaagtttcttgatatatttgagaaagaagggtgtaggatggtgccaatgacatgtgctgagcatgataagcatgctgcaggttcacagttcattacacatacaatggggagggtgttggagaagttgggtttggagtcaactcctattaatactaaagggtatgagactttgttgaatctggtggataatactgctagtgatagctttgacttgtactatgggctgtttatgtacaataaaaatgctatggaggagttggaaagacttgacttggcttttgaggctttgaagaaggagttattcgggcatttacatgatttgttgaggaagcaattgtttgggaaggcggaggaagcaggacagaggcgtgtcttatccaagttgcccaggaatggctatgcgctgccagccccttcatcggatgctgttaaacctgagaacaactga

SEQ ID NO: 57 - DNA, 1173 bp, Solanum lycopersicum
  misc_feature (1)..(1173): Solyc09g011870.1
atgttttccctttcatctatacaatctaacaatattcaatctcaatcatcttcgtcgctactcttcaatcatcatcaccagcattcaactatttcaactcggtttcatcaccaccgcctactcttccctctccgtgcccaaaatagcgacttaactacagccaccaccaataacaactatgtcgatcttgatgacaatctaaccagacttgataaattttcaaaatcattaagtatttcgaatatcgaagaaaatacatcattaaatcccctcttatgttccaataacaagctcaaaatagctatcataggctttggaaactttggacaatttattgccaaatcctttatcaaacaaggccatgttgtattagctcattcacgtagtgattattccctcatagcacaatcccttaatgtccacttctttcaagatcctaatgacttatgtgaacaacatcctgacgttattttactttgcacatccatcaattcactcgaaaacgtcattcgttcccttcccatccaaaagcttaaacgtaacacacttttcgtagacgtattatcagtcaaagaattcccgaaaaacatttttcttcaatcactaccaaaagaatttgatattttgtgtactcatcctatgtttggtccaacaagtggtaaagacaattggaaaggactaccatttatgtatgacaaagttagaattggacaagaagagtcaagaattaaaagagtcaacaattttatcaacatttttgtaaaagaaggttgtagaatggttgaaatgagttgtagtgaacatgacaagtatgctgctggatcacaatttattacacatactattggaagaatgttacaaagacttgggacacaaacaactcctataaacacaaaaggatatgaaagtttgttgaatttgatggagaatacaactagtgatagttttgatttgtattgtggtttgtttatgtataacaataattcaatggaggtgttagagaaactagatgcagcattggatagtttgaaaagggaattatttggacaagttcttcaaaagttggagaaaagagtggaaaagggaagtaggttagctttacctactcctgattttagtaagaaaattgaaaaattgaaagttgagaggaaggaactagaggcactttcttga

SEQ ID NO: 58 - DNA, 819 bp, Solanum lycopersicum
  misc_feature (1)..(819): Solyc06g050630.2_SolyncADH
atgtcttcatcttcttcttgtcaaccaaaaactttacgaattggcataattggatttggtcctttcgcccagtttctggccaaaactatgatgaaacaaggccattgtatccatgtaacttccagatcagattattcagagctttgtacagatttgggcatcctgttctttagagatatgggtgcatttctagaatcggataatgaagttataatgattagtacgtccatcctgtctctatcacaagttgtggagtccataccattcaattgtcttaagcggcctacgcttttcgttgatgtgctctctgttaaagaacacccaaaagatgtccttttgcgaatgatgcctcgagagtgtgacttgctgtgtacacacccaatgtttggaccagaaagtggtaaggatggatgggaagatttgacttttatgtacgacatggttcgaattagagatcaacccctctgttctagctttctccacatcttctcaagtgagggttgcaaaatgctggaaatgacttgtgaaaagcatgatagattagctgctcaaagtcaatttcttactcacacaatcggcaggatcttgtcggaaatggaggttgaaccgacaccaatagacacaaaaggatttcagaaacttgttcaagtgaaggagagctcagttaaagatagttttgatctgttcagcgggctattcatccacaataggtttgccaggcaacagatgaaaaatttagaagtagcattggagaaaactaaagagaaacttcaagagagatcgaaggagctgcaggatcctatcatatcaaagttctaa

SEQ ID NO: 59 - DNA, 819 bp, Solanum lycopersicum
  misc_feature (1)..(819): Solyc06g050630.2_SolyncADH D224N
atgtcttcatcttcttcttgtcaaccaaaaactttacgaattggcataattggatttggtcctttcgcccagtttctggccaaaactatgatgaaacaaggccattgtatccatgtaacttccagatcagattattcagagctttgtacagatttgggcatcctgttctttagagatatgggtgcatttctagaatcggataatgaagttataatgattagtacgtccatcctgtctctatcacaagttgtggagtccataccattcaattgtcttaagcggcctacgcttttcgttgatgtgctctctgttaaagaacacccaaaagatgtccttttgcgaatgatgcctcgagagtgtgacttgctgtgtacacacccaatgtttggaccagaaagtggtaaggatggatgggaagatttgacttttatgtacgacatggttcgaattagagatcaacccctctgttctagctttctccacatcttctcaagtgagggttgcaaaatgctggaaatgacttgtgaaaagcatgatagattagctgctcaaagtcaatttcttactcacacaatcggcaggatcttgtcggaaatggaggttgaaccgacaccaatagacacaaaaggatttcagaaacttgttcaagtgaaggagagctcagttaaaaatagttttgatctgttcagcgggctattcatccacaataggtttgccaggcaacagatgaaaaatttagaagtagcattggagaaaactaaagagaaacttcaagagagatcgaaggagctgcaggatcctatcatatcaaagttctaa

SEQ ID NO: 60 - DNA, 2049 bp, Gossypiumraimondii
  misc_feature (1)..(2049): Graimondii10g059700.1
atgattactcatccttgtctccatccgtccctttccaagccctctctttcttttctttcctcatcctctccacctttcctccaacacctctctttccttccaacatcaccttcagtaacaaaacccgtatttgtccattccgttaaaccactccatgtcaaatgctcctccaccaatcccacatcccaatcccacccagaccatgcaccacccatttccaccctcaagattgccatcattggcttcggtaactacggccagtttcttgctaaaactcttgtttctcaaggccacatagttttagcccactcgagatccgattattcccacgtagccaaaaaactgggagtttccttcttcttaaacccccacgacttatgtgagcaacacccagaagttatactcctttgtacttcaattatctcaaccgaacaagttttgaaaactcttcctttacagagacttaaacgctccacgttgtttgtcgatgttttatccgtcaaagagttcgccaggaatctactcctcgatgccttgccccttgatttcgacatcatttgttcgcatcccatgttcggaccacaaagcgccaagcaaagctggaaagacctcttctttgtttacgaaaaggttagaatcggaaacgaatcctccagggttcaaagatgtgaacaattccttgaaatttttcaaagtgaagggtgtaaaatggtggaaatgagctgccaggagcacgacaagcttgcggcggggtcacagtttatgacacacacggttggaagagtgttggacatgttggggttggagtcaacgccgattaatacaaagggttatgagactttgttggatttggttgagaatacttgtagggatagctttgatttgtattacgggttgtttctgtataataagagtgctttggagatggtggagaggttagatttggcctttgatgctttaaggaatgagctttttggtaggctgcatcatgttgtgaggaaacagttttttgagaatggagagaaggtaaagagtgtgcatgatagtagttaccaaaatggtgctgcatcggctttcagctcaaatgctttgagatctcaagatgttactataccttatgaattcaaaggaaagatattggaaagtgttgatgacagttcaaagctcaaggttgcgattgttggatttggaaactttggccagttccttgcaaagactctggctcgtcagggccactctgttttagcctattctcgaactgattatcgagatgcagctcagaaattgggggtttctttcttctctgatgctaatgacctctgtgaagagcatcctgaagttattctcttgtgcacctcgattctttcgactgaaaaagttctcaagtcattgccttttcagagattgaagagaagtactctgtttgttgatgtactatcagtgaaggagtttccaaggaatttgtttcttcaacatttaccgccagagtttgatattctatgcacacatcccatgtttggacctgaaagtggtaaaaatggatggaacgagcttccttttgtttttgataaggtgaggattggaaatgatgaaagacgggtagctcgatgtaatagtttccttgatatttttgcaagagaaggatgccgaatggtggagatgacatgtgcagaacatgattggcatgcggcaggttcgcagtttattacccatacgatgggcagggttttggagaagctgcagttggagtctacaccaattaacacaaaaggttacgagactctgttgaatttggtggagaatacagcaggagacagctttgacctttattatgggcttttcatgtacaatgtaaatgctatggaacagcttgagagaatggattttgcgtttgagtcattgaagaagcagctctttggtagattgcatggtgttcttcggaaggaactgtttggagattcagagaagcttgaggtattgcaggagaaatcagttaggaaaaatggtgcagcactttcatcttctccggagagtgttaaaatcagctag

SEQ ID NO: 61 - DNA, 1116 bp, Gossypiumraimondii
  misc_feature (1)..(1116): Graimondii09G126800.1
atgttgattttctctcccacaaccataagatctgtgaatccccaacccctcccttacctctccttttcccactccatttctctccctctcccactaacgtctctccccactccctccaaatccccccatttcccttccttccatatcaactgcatagacgcagctcaaccattcgactacgagtcccatctcaaaaaccgctacattcaatcaacttccctcaagatcgccattatcggcttcggtaacttcggccaattcctatccaaaactttcctccgccatcacactctcctcgcccactccagaactaactacgccgacctcgctaaccacctcggcgtttccttctacgccgacccacacgaccttttcgagcaacaccctgacgtcgtccttctctctacttccatcctttccactgaaactcttcttcagaaactgccctttcaacgactgcgtcgcaacacccttttcgtcgacgtgctttctgttaaagagttccccaggaaccttttcttgaagtatttacccccagatttcgatatcttgtgtacccatcccatgtttggacccgaaagtggcaaaacctcgtgggcggggcttccttttgtctacgacaaagtgaggatcggggatgaggagagtcggataaagagatgcgacaagtttttggatattttcgagaaagaagggtgtagaatggtggagatgagttgcatggagcatgataagtacgcggcggggtctcagttcgtgacccataccatggggagagtgctggagaagttcgggttggagtcttcgcctattaacaccaaagggtacgagacattgttgaatttggtggagaatactaaaggggatagctttgatttgtattatgggttgtttatgtataaccagaacgctttggagcagttggaaaggttggatatggcattcgagtcgattaagaaggacttgtttgggaggctccatcaggtttataggaagcaattgtttggggataataatggagaggtggagaagaagaggagtttggctcagcagttgcttggcaatggaagtttaaccgaatctccattggataatgttagacaagatggatcttga

SEQ ID NO: 62 - DNA, 813 bp, Gossypiumraimondii
  misc_feature (1)..(813): Graimondii06g129300.1
atgtcgtcgtcgtcttccttgcctctgcaaactctaaaaataggcatcgtcggttttggtacatttgggcagttcctggcaaagacaatgatcaaacaaggccatactactagggcaacttctcggacagattattcccagctttgtcatcaattggatgttcccttcttcagggacgtaattccatttcttgaagcagataatgatgtgatattgatatgcacgtcaatcctatctctatcggaggtgctcaactcaatgccattacgtcgcctcaaacgccacacgttgtttgtcgatgtgctctcggtcaaagaacacccaagaaacgttttattgcaagttttgccagagaatatggacgtgctctgcactcatccaatgtttggacctgaaagtggaaaaaatggatggaaagatcttcctttagtgtatgagaaagttcgggtgaggaatgaaactaggtgctccagcttcctacacatctttgaatctgagggttgcagaatggtggaaatgtcttgtgaagaacatgacaaagttgccgctagaagtcaatttctttcccattcaatcggcaggattttggcggaaatgggaattgaatccacatccatgaacaccaaaagcttcgaaacacttgttaaattgaaggagagcgccaccaatgatagtttcgatctgttcagtgggttattcatccataacaggtttgctcaacaagagctgatgaacctagagcagtcatttgaaaaggtcaagcagaggctgcttaagaagatgagcgaacagcaaagtcttagctcggtctaa

SEQ ID NO: 63 - DNA, 837 bp, Theobroma cacao
  misc_feature (1)..(837): Tcacao1EG040641t1
atgtcttcttcatctgattccttttcctcactgacactaaatataggcatagtcggttttggcacatttgggcagttcctggcaaagacaatgatccaacaaggccataccataagtgcaacttctcggacagattattcccagctctgtcatcaattgggtatttccttcttcagggatgtagctgcattcgttgaagcagataacgatgtcatattgataagcacatccatcctatctctatcaaagatgctcaagtcaatcccattccgttgccttaaacgccggacactcttcgtcgacgtgctttccgtcaaagaacacccaagggacgttcttttgcaagttttgccagaggaaatggacttgctttgcactcatcccatgtttggacccgaaagtggcaaaagtgggtgggaagatcttgttttaatgtatgacaaagttcgggtgagggatgaagctacgtgttccagcttcctacgcatctttgaacgtcagggttgcagaatgatgcaaatgtcctgtgaagaacatgacagactggctgctaggagtcaatttcttactcatgctatcggcaggattttgtcagaaaccggaattgaatctacgtcaattaacaccaaaagcttcgaaacactagttaaattgaaagagagcaccaccaatgatagtttcgatctgttcagcggattattcatccataacagatttgccaaacaagagttgatgaatctagagcatgcttttcaaatggtcaagaagaagctgctacagacggcgaacgaagagcaaattcccaacaagtctaaccatcaaatggactcttgctaa

SEQ ID NO: 64 - DNA, 2205 bp, Theobroma cacao
  misc_feature (1)..(2205): Tcacao1EG038186t1
atggctatgccatcactttccttcctccaccaatcgcctccaaaaccttcacatgtctatttctgtaacccatctcctccgccacttttcctccaatctccttcttttgtttacatgacgacacccctctctctgcattcctccaaagcactccaaatcaggtcgtccttctcctcaacatcgacttccgaacctacccaagaccctgtcaggcttgctttttctgtcaattcaacccttaaaattgccatcataggctttggaaactacggccaacacctggctaaaaccctggtagctcaaggacacagtcttttagcctactcgagatccgaccattcccacattgctcaagagcttggagtctccttctttctaaaccccagtgacctttgcgaacaacaccctgatgtcatcctcctctgtacttcgattatctccaccgaacaagtcttgaaatctcttcctctaaaaagactgaagcggtccacattgtttgtcgatgtcctctccgtcaaagagttcgccaagaacctcctcctcgacgtcttgcctcctgatttcgacatcatttgttcccaccccatgttcggaccacaaagcgccaaacaaagctgggaaaacctcttctttatgtacgaaaaggttagaattgggaacgaatcctccagggtccaaagatgcaacgattttcttgcaatatttgaaagagaggggtgtaaaatggtggaaatgagctgtcaagagcacgacaagttggcagccgggtcacagtttatgacgcacacggtaggcagggttttggacatgttggggctggagtcaacgccgattaatacaaagggttatgaaactttgttggaactggtggagaatactcgaggggacagctttgatctctactacgggctttttttgtataataagagtgctttggagatgcttgagaagttggatttgggttttgatgagttgcggaatgagctctcagggagattgcacgatgtagtgaaaaagcaattgttcgagaatgcagcaaggggaaagagtctgcaagataaaagttaccaaaatagtgctggaatggcgtcgatcttaaactccctgagatctcaagatgctattcaaccatatgaatacaaagagaagatctccgaaagcattgatgatagttcaaagctgaagattgcgattgtcgggtttggaaactttggtcagttccttgcaaaagccttcgttcgacaaggccactcagttttagcctattctagaacagactactgtgctgtggctcagaaattgggagtttctttcttctctgatgctgatgatctctgtgaagagcatccagatgttattcttttatgtacttcgattctttctactgaaaaagttctcaactcattgccgctacagagattgaagagaagcaccctgtttgtcgatgtactatcagtgaaagagtttccaaggaacttgtttcttcaaaatttaccctcagactttgatattctatgcacacatcccatgtttggacccgaaagtggtaaaaatggatggaaagatctcgctttcgtttttgataaagtgagggtcggaagtgatgaaaaaagggtagcaaggtgcaatagagtcctcgacgtttttgctcgagaaggatgccggatggtggagatgtcctgtgcagaacatgattggcatgcagcagggtcacagtttattacacacacgatgggaagggttttggagaagttaaagttggagtccacaccaattaacactaaagggtatgaaactttgttgaatttggtggagaacaccgctggggatagctttgatctttattatgggctttttatgtacaatgtaaacgccctggaacaactagagaagttagatttggcttttgagtcattgaagaagcagctctttggtagattacatggtctctttcagaggcaattggttggaaatgccgacgagaagcttcaagtacttcagaacggaaagggtaaagtttttcctgagaaatcagttgtgccatatggggcggcaatgcctgcatctcccaaagagaaattccacgttttatgggagaattcagtactgcaggcatcccctgaaaataggcttgaagttgtggaggagaagtctgttaggagaaatggtgctgcccttgcaacttctccagaaagcgtcagttag

SEQ ID NO: 65 - DNA, 1407 bp, Theobroma cacao
  misc_feature (1)..(1407): Tcacao1EG027290t1
atgattaaaaagaatgaagatgctaccttccttccttcagtgcacttgcacttgaccaaattgttgttggttgggggtcttgaacccaacttgaccaatttgcagaagaaaaaggtcaaagtggtcgagccccagcccaccacctctgactctaaactaggtccacagagagaaggaaagatcaaatctccattgaagtattcaattccccagttaggagaagcaaacggaaataccatctttgaatctgttcattgtctcccacaattctgtgtcaagtttcgaattttgagaatgctgctattctctgccacaagaccgctcaatcccccccaacccctccctttcctctccttctcccgcttcgtttccctctctctgcctctccctatcctgccgaacccttccagatccacccacttcccttctctccaaatttactccattgacgcagctcaaccttttgactacgaatcccacctcaaaaaccgttacctccaatccacttccctcaagatagccataataggctttggcaacttcggtcagttcctctccgaaaccttcatccgtcaccaccacactctcctcgctcactcaagaacaaactacaccaacctcgctaaccaactgggcgtctctttcttctccgacccaaacgaccttttcgagcaacaccctgacgtcgtcctcctctctacttccattctttcaactgaaaccttactacaacagctaccctttcaaagactacgtcgaaacacactttttgtcgacgtactttcagttaaagagtttcccagaaacctttttttgaagtacttacctccagacttcgatattttatgtacgcatcccatgttcgggcctgaaagtggtaaaaatacgtgggcgggacttccttttgtttatgataaagtgaggattggagatgaagagagcagggtaaagagatgtgagaagttcttagacatttttgaaaaagaaggatgtagaatggtggagatgagttgcatggagcatgataagtacgcggcggggtctcagttcgtgactcatacgatgggtagagtgctggagcagtttgggttagagtcttcgcctattaataccaaagggtatgagacattgttgaatttggtggagaatactaaaggagatagctttgatttgtattatgggttgtttatgtataaccagaatgctttggagcagttggagaggttggatatggctttcgaatcgattaagaaggagttgtttggaaggctacatcgggtttataggaagcagttgtttggggataaggaggagaaggagagagagagaaggtttgctcagaagctgcttggcaatggaggtctaattgaccctcctttggataatgttggacaagatggatcctaa

SEQ ID NO: 66 - DNA, 822 bp, Bituminaria bituminosa
  misc_feature (1)..(822): Bbituminosa68922
tttagcaccatgagcaccagcagcagctttcagaacctgaaaattggcattgtgggctttggcaactttggccagtttctggcgaaaaccatgattaaacagggccataccattaccgcgaccagccgcagcgattatagccagctgagcctgcagatgggcattcatttttttcgcgatattagcgaatttctggcggtggatattgatgtgattgtgctgtgcaccagcattctgagcctgagcgaagtggtgggcagcatgccgctgaccagcctgaaacgcccgaccctgtttgtggatgtgctgagcgtgaaagaacatccgcgcgaagtgctgctgcgcgtgctgccggaagatagcgatattctgtgcacccatccgatgtttggcccgcagaccgcgaaaaacggctggaaagatcatacctttatgtttgataaagtgcgcattcgcgatgaagcgacctgcagcaactttattcagatttttgcgagcgaaggctgcaaaatggtgcagatgagctgcgaagaacatgatcgcgcggcggcgaaaagccagtttattacccataccattggccgcaccctgggcgaaatggatattcagagcaccccgattgataccaccggctttgaaaccctggtgaaactgaaagaaaccatgatgaaaaacagctttgatctgtatagcggcctgtttgtgtataaccgctttgcgcgccaggaactggaaaacctggaacatgcgctgcgcaaagtgaaagaaaccctgatgattcagagcattgatgaagaacaggataaaaaaattaccgaaagc

SEQ ID NO: 67 - DNA, 798 bp, Astragalusmembranaceus
  misc_feature (1)..(798): Amembranaceus5597
gcgagcagccagagcctgaaaattggcattgtgggctttggcacctttggccagtttctggcgaaaaccatgatgaaacagggccataccctgaccaccaccagccgcagcgattatagcgaaatttgcaaccagatgggcattcatttttttcgcgatgtgaccaccctgctggatgcggatatggatgtgctgctgctgtgcaccagcattagcagcctgagcgaagtggtgggcagcatgccgctgacccgcctgaaacgcccgaccctgtttgtggatgtgctgagcgtgaaagaacatccgcgcaacctgctgctgcaggtgctgccggaagaaagcgatattctgtgcacccatccgatgtttggcccggtgagcggcaaaaacggctggaaagaactgacctttatgtttgataaagtgcgcattcgcgatcaggtgacctgcagcaaatttctgcagatttttgaaaccgaaggctgcaaaatggtggaaatgagctgcgaagaacatgataaagcggcggcgaaaagccagtttattacccataccattggccgcaccctggcggaaatggatattaaaagcaccccgattgataccaaaggctttcaggcgctgaaccagctgaaagataccgtgatgggctgcagctttgatctgtatagcggcctgtttgtgtataaccgctttgcgcgccaggaactggaaaacctggaacatgcgctgcataaagtgaaagaaatgctggtgccgcgcattaacgaagaacatggcccggaacgcaccgaaagc

SEQ ID NO: 68 - DNA, 795 bp, Glycyrrhizaglabra
  misc_feature (1)..(795): Gglabra9954
aacagcaacagccagagcctgaaaattggcattgtgggctttggcacctttggccagtttctggcgaaaaccatgattaaacagggccataccctgaccgcgaccagccgcaccgattatagccagctgtgcattcagctgggcattcatttttttcgcgatgtgagcgcgtttctggatgcggatatggatgtgattctgctgtgcaccagcattccgagcctgagcgaagtggtgggcagcatgccgctgacccgcctgaaacgcccgaccctgtttgtggatgtgctgagcgtgaaagaacatccgcgcaacctgctgctgcgcgtgctgccggaagaaagcgatattctgtgcacccatccgatgtttggcccggtgagcggcaaaaacggctggaaagatctgatttttatgtatgataaagtgcgcgtgcgcgatgaagtgacctgcagcaaactgctgcagatttttgcgagcgaaggctgcaaaatggtggaaatgagctgcgaagaacatgataaagcggcggcgaaaagccagtttattacccataccattggccgcagcctggcggaaatggatattaaaagcaccccgattgataccaaaggctttcaggcgctggtgcagatgaaagaaaccgtgatgggctgcagcagcgatctgtatagcggcctgtttctgcataaccgctttgcgcgccaggaactggaaaacctggaacatgcgctgtataaagtgaaagaaatgctggtgcagaaaatgaacgaagaacagagcccggaacgcacc

SEQ ID NO: 69 - DNA, 771 bp, Glycyrrhizaglabra
  misc_feature (1)..(771): Gglabra8888
agcagcagcaccctgaaaattggcattgtgggctttggcagctttggccagtttctggcgaaaaccatgattaaacagggccataccctgcgcgcgaccagccgcaccgattatagccatctgtgcctgcagatgggcattcgcttttttcgcggcgtgattgcgtttgtggaagcggataacgatgtgattctgatttgcaccagcattctgagcctgagcgaagtgctgcgcagcatgccgctgagccgcctgaaacgcccgaccctgtttgtggatgtgctgagcgtgaaagaacatccgcgcgatctgctgctgcgcgtgctgccggaagatagcgatattctgtgcacccatccgatgtttggcccggaaagcggcaaagatggctggaaagatctgacctttgtgtatgataaagtgcgcattcgcgatgaagcgatttgcagcaactttctgcatatttttgcgagcgaaggctgccgcatgctgcagatgagctgcgaagaacatgataaagtggcggcgaaaagccagtttattacccataccattggccgcaccctggaagaaatgaacattgaaagcaccccgattgataccaaaggctttcagaccctggtgcagctgaaagataccaccatgcgcgatagctttgatctgtatagcggcctgtttattcataaccgctttgcgaaacaggaactggaaaacctggaacatgcgctgcataacgtgaaagaaatgctggtgcagaaaatgaacgaagat

SEQ ID NO: 70 - DNA, 792 bp, Bituminaria bituminosa
  misc_feature (1)..(792): Bbituminosa16676
acctggagcctgaaaattggcattgtgggctttggcagctttggccagtttctggcgaaaaccatgattaaacagggccataccctgcgcgcgaccagccgcaccgattatagccatctgtgcctgcagatgggcattcagttttttcgcgatgtggcggcgtttctggaagcggataacgatgtgattctgatttgcaccagcattctgagcctgagcgaagtgctgagcagcatgccgctgacccgcctgaaccgcccgattctgtttgtggatgtgctgagcgtgaaagaacatccgcgcaacctgctgctgcgcgtgctgccggaagaaagcgatattctgtgcacccatccgatgtttggcccggatagcggcaaatatggctggaaagatctgacctttgtgtatgataaagtgcgcattcgcgatgaagcgatttgcagcaactttctgcagatttttgcgagcgaaggctgccgcatgctgcagatgagctgcgaagaacatgataaaattgcggcgaaaagccagtttattacccataccattggccgcaccctggcggaaatggatattaaaagcaccccgattgataccaccggctttcgcaccctggtgcagctgaaagataccaccattcgcgatagctttgatctgtataacggcctgtttctgcgcaaccgctttgcggtgcaggaactggaaaacctggaaaacgcgctgcataaagtgaaagaaattctggtgcagcgcaaaagcgaagaactgggcctggaaaaaaccgaatgc

SEQ ID NO: 71 - DNA, 816 bp, Glycine max
  misc_feature (1)..(816): Gmax18g02650_GmPDH1
atgtcaacctcatcctcttcccaaagcctcaaaattggcatagttggattcggcaactttggccagtttctggccaagacaatgataaaacaaggccacactctcacagcaacttctcgatctgattactctgaactttgtctccaaatgggcatccattttttcagggatgtcagcgcattccttaccgcagacatagatgtcatagtgttgtgcacatcgatattatcgctatccgaggttgtcgggtcaatgccactcacctccctgaagcgaccaacgctctttgttgatgttctttctgtcaaagagcacccaagagagcttctactgcgagagttgccagaggattcggacatactctgcacgcacccaatgtttggtcctcagactgccaagaatggatggacagatcacactttcatgtatgacaaagttcggataagagacgaagttatctgctctaatttcatccaaatttttgctactgagggttgcaagatggtacagatgtcctgtgaggaacatgacagagcagctgctaagagccaatttatcactcacacaattggcaggacactgggagaaatggatattcaatccacacctattgacactaagggcttcgagacacttgttaaattgaaggagacgatgatgagaaatagttttgatttgtatagtggattattcgtgtataacagattcgccagacaagagctggaaaaccttgaacatgccttgcacaaagtcaaagaaacgctgatgatacaaaggacgaatggggagcagggtcataaaagaactgaaagttga

SEQ ID NO: 72 - DNA, 816 bp, Glycine max
  misc_feature (1)..(816): Gmax18g02650_GmPDH1 M219T
atgtcaacctcatcctcttcccaaagcctcaaaattggcatagttggattcggcaactttggccagtttctggccaagacaatgataaaacaaggccacactctcacagcaacttctcgatctgattactctgaactttgtctccaaatgggcatccattttttcagggatgtcagcgcattccttaccgcagacatagatgtcatagtgttgtgcacatcgatattatcgctatccgaggttgtcgggtcaatgccactcacctccctgaagcgaccaacgctctttgttgatgttctttctgtcaaagagcacccaagagagcttctactgcgagagttgccagaggattcggacatactctgcacgcacccaatgtttggtcctcagactgccaagaatggatggacagatcacactttcatgtatgacaaagttcggataagagacgaagttatctgctctaatttcatccaaatttttgctactgagggttgcaagatggtacagatgtcctgtgaggaacatgacagagcagctgctaagagccaatttatcactcacacaattggcaggacactgggagaaatggatattcaatccacacctattgacactaagggcttcgagacacttgttaaattgaaggagacgacgatgagaaatagttttgatttgtatagtggattattcgtgtataacagattcgccagacaagagctggaaaaccttgaacatgccttgcacaaagtcaaagaaacgctgatgatacaaaggacgaatggggagcagggtcataaaagaactgaaagttga

SEQ ID NO: 73 - DNA, 816 bp, Glycine max
  misc_feature (1)..(816): Gmax18g02650_GmPDH1 N222D
atgtcaacctcatcctcttcccaaagcctcaaaattggcatagttggattcggcaactttggccagtttctggccaagacaatgataaaacaaggccacactctcacagcaacttctcgatctgattactctgaactttgtctccaaatgggcatccattttttcagggatgtcagcgcattccttaccgcagacatagatgtcatagtgttgtgcacatcgatattatcgctatccgaggttgtcgggtcaatgccactcacctccctgaagcgaccaacgctctttgttgatgttctttctgtcaaagagcacccaagagagcttctactgcgagagttgccagaggattcggacatactctgcacgcacccaatgtttggtcctcagactgccaagaatggatggacagatcacactttcatgtatgacaaagttcggataagagacgaagttatctgctctaatttcatccaaatttttgctactgagggttgcaagatggtacagatgtcctgtgaggaacatgacagagcagctgctaagagccaatttatcactcacacaattggcaggacactgggagaaatggatattcaatccacacctattgacactaagggcttcgagacacttgttaaattgaaggagacgatgatgagagatagttttgatttgtatagtggattattcgtgtataacagattcgccagacaagagctggaaaaccttgaacatgccttgcacaaagtcaaagaaacgctgatgatacaaaggacgaatggggagcagggtcataaaagaactgaaagttga

SEQ ID NO: 74 - DNA, 816 bp, Glycine max
  misc_feature (1)..(816): Gmax18g02650_GmPDH1 N222A
atgtcaacctcatcctcttcccaaagcctcaaaattggcatagttggattcggcaactttggccagtttctggccaagacaatgataaaacaaggccacactctcacagcaacttctcgatctgattactctgaactttgtctccaaatgggcatccattttttcagggatgtcagcgcattccttaccgcagacatagatgtcatagtgttgtgcacatcgatattatcgctatccgaggttgtcgggtcaatgccactcacctccctgaagcgaccaacgctctttgttgatgttctttctgtcaaagagcacccaagagagcttctactgcgagagttgccagaggattcggacatactctgcacgcacccaatgtttggtcctcagactgccaagaatggatggacagatcacactttcatgtatgacaaagttcggataagagacgaagttatctgctctaatttcatccaaatttttgctactgagggttgcaagatggtacagatgtcctgtgaggaacatgacagagcagctgctaagagccaatttatcactcacacaattggcaggacactgggagaaatggatattcaatccacacctattgacactaagggcttcgagacacttgttaaattgaaggagacgatgatgagagctagttttgatttgtatagtggattattcgtgtataacagattcgccagacaagagctggaaaaccttgaacatgccttgcacaaagtcaaagaaacgctgatgatacaaaggacgaatggggagcagggtcataaaagaactgaaagttga

SEQ ID NO: 75 - DNA, 816 bp, Glycine max
  misc_feature (1)..(816): Gmax18g02650_GmPDH1M219T N222D
atgtcaacctcatcctcttcccaaagcctcaaaattggcatagttggattcggcaactttggccagtttctggccaagacaatgataaaacaaggccacactctcacagcaacttctcgatctgattactctgaactttgtctccaaatgggcatccattttttcagggatgtcagcgcattccttaccgcagacatagatgtcatagtgttgtgcacatcgatattatcgctatccgaggttgtcgggtcaatgccactcacctccctgaagcgaccaacgctctttgttgatgttctttctgtcaaagagcacccaagagagcttctactgcgagagttgccagaggattcggacatactctgcacgcacccaatgtttggtcctcagactgccaagaatggatggacagatcacactttcatgtatgacaaagttcggataagagacgaagttatctgctctaatttcatccaaatttttgctactgagggttgcaagatggtacagatgtcctgtgaggaacatgacagagcagctgctaagagccaatttatcactcacacaattggcaggacactgggagaaatggatattcaatccacacctattgacactaagggcttcgagacacttgttaaattgaaggagacgacgatgagagatagttttgatttgtatagtggattattcgtgtataacagattcgccagacaagagctggaaaaccttgaacatgccttgcacaaagtcaaagaaacgctgatgatacaaaggacgaatggggagcagggtcataaaagaactgaaagttga

SEQ ID NO: 76 - DNA, 825 bp, Glycine max
  misc_feature (1)..(825): Gmax11g35760
atgacaaccatgtcaacctcatcctcttcccaaagcctcaaaattggcattgttggattcggcaactttggccagtttctggccaagacaatgattaaacaaggccacactctcacagcaacttctcgatctgattactctcaactttgtctccaaatggggatccattttttcagggatgtcagcgcattcctcgccgcagacatagatgttatagtgttgtgcacatcgatattatcgctatccgaggttgtagggtcaatgccactcacttccctgaagcgaccaacgctctttgttgatgttctttctgtgaaagagcacccaagagagcttctactacgagagttgccagaggattcagacatactctgcacgcacccaatgtttggtcctcagactgccaataatggatggacagatcacactttcatgtatgacaaagttcggataagagacgaagctacttgctctagtttcatccaaatctttgctactgagggttgcaagatggtacagatgtcctgtgaggaacatgacagagcggctgctaagagccaatttatcacacacacaattggcaggacattgggagaaatggatattcaatccacacctattgacactaagggctttgagacacttgttaaattgaaggagactatgatgagaaatagttttgatttgtacagtggattattcgtgtataacagattcgccagacaagagttggaaaaccttgaacatgccttttacaaagtcaaagaaacgctgatgatacaaaggtcgaatggggagcagggtcataaaagaaccgaaagttga

SEQ ID NO: 77 - DNA, 2073 bp, Glycine max
  misc_feature (1)..(2073): Gmax17g13151
atggctgtttccacctttcaggcgccgccactgaagccctcattgccttccactcttctccggcgcctcaaacgcgtgcccctctcccactccttctcattattctccgctccaaacacaaacagctttcattcttcttacagagccctccgtattcgcgccatcgacgcggcccagccattcgactacgagtcgagaatggcccaacaattccacgacgcccagaagctgaagatcgccatcgtgggcttcggcaacttcgggcagttcctggcccaaaccctcgtccggcagggccacaccatcctggcccactcccgctccgaccactctctctcggcccaacaactcggcgtcaccttcttccaaaacccccacgacctctgcgaagaacaccccgaagtcatcctcttatgctcctccatcatctccacccagcgcgtgctcctcactctccccctccagcgcctcaaacgcagcacactcttcgtcgacgtcctctccgtcaaggaattccccaaaaaccttctcctccacgcgctcccccccgatttcgacgttctctgcactcaccccatgttcggcccccagagcgccccacgcgcctggaccggcctccccttcgtctacgagaaggtccgaatcggcgcccacgacgaccgccgaatcgcgcgctgcgagaaattcctcggaattttcgccagagaaggttgcaggatggtggagatgagctgcgccgatcacgacaagttggcggccgggtcgcagttcataacgcacaccgttggtagggttttggagatgctgaccgtaaagtcaactccgattaacaccaaaggctacgagtcgttgttgaatttggtggagaacacttgcggggacagctttgatctgttctatggattgtttatgtataataagaactcgctggagatgctggagaggttggatttcgccttcgaggacttgaggaaacagctcatggcgcgtttgcatgatgttgttagagagcacttgtcggataatgctggaattgggaaggtgcagagtttgcctgatgaatatgtccatcaactgctgctcaagaacggtcaaaatggatctgctgctgcacctctgctgtcactgccctccgaagatctgagatctggtgatgttgttaaactcaacaactacaagtcaaatgatgcaaaccagtctgatgacaactccaagctcaagattgcgattgttggttttggcaactttggtcagtttcttgcgaaaacttttgtgcgtcatggtcatcgagtgttggcatactctagatcagattactctctcgtggctcaggaattgggggtttcatatttcaataacattgacgatctttgtgaacaacacccagaagtgattttactttgcacttcaatcctttccaccgagaaagttcttaaatcattgcccgtgcaaagattgaagagaagtactctgtttgttgatgtactttctgtcaaagaatttcctagaaacttgtttcttcagcatttgccgcgtaattttgatattctctgcactcatcctatgtttgggccagagagtggaaaaaatgggtggaatggtcttgcttttgtttttgataaagttagaataggaatagatgaatcaagatcatcacggtgtgatcagtttcttgacatttttgctagtgaagggtgccgaatggttgaaatgtcatgtgctgaacatgattggcatgcagctggatcacaatttatcacgcatactaccggaagatttttagaaaaactggaattggagggaacgccaattgacacaaagggctatgagactttgttgagtttggtggaaaatactgctggagatagttttgatctatactatggtttgttcttgtataatagaaatgccatggagcaactagaaagatttgatctggcttttgagtctgtgaagaagcagctttttgatcgtctgcatggcttctaccgacagcaagtatttaaacatgaagaaaaactccatgactcgccagaaaggcgtatgttgcctaagatatctgaagataaataa

SEQ ID NO: 78 - DNA, 2058 bp, Glycine max
  misc_feature (1)..(2058): Gmax05g07870
atggctgtttccacctttcaggcggcgccaccgaaacccacattgggttccagtcttcttagccgtcgtatgaaacacgttcccttctccttgtcatttttctccgctcctaagaccatctcttcttacagacccatcctacgcattcgcgccatcgacgcggcccagcccttcgactacgagtccagaatggcccaacagttccacgactcccagaagctgaagatcgccatcgtgggcttcggcaacttcgggcagttcctggcccaaaccctcgtccgccagggccacaccgtcctggcccactcccgctccgaccactccctcgcggcccaacaactcggcgtcaccttcttcccaaacccccacgatctctgcgaggaacaccccgaagtgattctcttatgctcctccatcatctccacccagcgcgtgctcctcactctccccctccagcgcttaaaacgcagcacactcttcgtcgacgtgctttccgtcaaagagttccccaaaaacctccttctccacgcgctcccctccgatttcgatgttctctgcacccaccccatgttcggcccacagagcgccccccgcgcttggaccggcctccccttcgtctacgagaaggtccgaatcggctccgacgagcaccgaatcgcccgctgcgagaaattcctcggcattttcgcgagggaggggtgcaggatggtggagatgagctgcgccgaccacgataagttcgctgccgggtcgcagttcataactcacaccgttggtagggttttggagatgcttacggtggagtcaactccgattaacacgaaaggttacgagtcgttgttgaatttggtggagaacacttccggggacagttttgatctcttctatgggttgtttatgtataataagaactcgctggagatgctggagaggttggatttcgccttcgaggacttgaggaaacagctcatggggcgtttgcatgatgttgttagagagcagttgtttgataatgctggaatgggaaaggtgcagagtttgcctgatgaatatgtccatcaactgctgctcaagaatggtcaaaatggttctgctgcacctgtgctatcactgccctccaatgatctgagatccagtgatgttgttaaactctacaactacaagtcaaatgatgcaaaccagtctgatgacaaaaccaagctcaagattgcaattgttggttttggcaacttcggacagtttcttgcaaaaacttttgtgcgtcatggtcatcaagtgttggcatactctagatcagattactctcacgtggctcaagaattgggggtttcatatttcaataacattgacgatctttgtgaacaacatccagaagtgattttactttgcacttcaatcctttccacagaaaaagttcttaaatcattgcccgtgcaaagattgaagagaagtactttgtttgtggatgtactttctgtcaaggaatttcctagaaacttgtttcttcatcatttgccacataattttgatattctctgcactcatcctatgtttgggccagagagtggaaaaaatgggtggaatggtcttgcttttgtttatgataaagttagaataggaatagatgaatcaagaacatcacggtgtgatcagtttcttgacatttttgctagtgaagggtgccgaatggttgaaatgtcatgtgctgaacatgattggcatgcagctggatcacaatttatcacgcatactaccggaagatttttagaaaaactggagttggagggaacgccaattgacacaaagggctatgagactttgttgagtttggtggaaaatactgctggagatagttttgatctatactatggtttgttcttgtataatataaatgccatggagcaactagaaagatttgatctggcttttgagtctgtgaagaaggagctttttgatcgtctgcatggcttctaccgacagcaagtatttaaacatgaagaaaaactccatgatttgccagagaggcctatgttgtctaagatatctgaagataaataa

SEQ ID NO: 79 - DNA, 801 bp, Glycine max
  misc_feature (1)..(801): Gmax14g05990_GmncADH
atgtcaacatggtctctgaaaattggcgtagttgggtttggttccttcgggcaatttctggcaaagactatgatcaaacaaggccacactctaagggcaacttctcgtactgactactccctcttatgcctcccaatgggtatccaattcttcagggatgttgctgcattccttgaggctgacaacgatgtcatactcgtatgtacgtccatcctatctctctccgaggttctcagctctatgccactcacttgtctcaaaagatcaacactctttgttgatgtcctttcagttaaagagcacccaagaaatcttctaattaaggtattgccagaggagtcagacatactgtgcacacacccaatgtttggaccagatagtgggaaggatgggtggcaagatctaacattcgtatatgataaagttcgaatccgagatgaagctatctgctctagcttcctccacatttttgcaagtgagggctgcaggatgctacaaatgtcttgtgaggaacatgataaaatagctgccaagagtcaatttattacacacactataggcaggacattggcagaaatggatatcaagtccacacctattgatacaaaaggctttcattcacttgttcaattgaaggacaccaccatcagagatagttttgacttgtacagtggattattcttacataataggtttgctgtacaagagttggagaatcttgaacatgccttgcacaaagtcaaagaaatgctggttcaaaggaagagtgaggagctgggtctagaaaaaactgaatgttga

SEQ ID NO: 80 - DNA, 801 bp, Glycine max
  misc_feature (1)..(801): Gmax14g05990_GmncADH D218N
atgtcaacatggtctctgaaaattggcgtagttgggtttggttccttcgggcaatttctggcaaagactatgatcaaacaaggccacactctaagggcaacttctcgtactgactactccctcttatgcctcccaatgggtatccaattcttcagggatgttgctgcattccttgaggctgacaacgatgtcatactcgtatgtacgtccatcctatctctctccgaggttctcagctctatgccactcacttgtctcaaaagatcaacactctttgttgatgtcctttcagttaaagagcacccaagaaatcttctaattaaggtattgccagaggagtcagacatactgtgcacacacccaatgtttggaccagatagtgggaaggatgggtggcaagatctaacattcgtatatgataaagttcgaatccgagatgaagctatctgctctagcttcctccacatttttgcaagtgagggctgcaggatgctacaaatgtcttgtgaggaacatgataaaatagctgccaagagtcaatttattacacacactataggcaggacattggcagaaatggatatcaagtccacacctattgatacaaaaggctttcattcacttgttcaattgaaggacaccaccatcagaaatagttttgacttgtacagtggattattcttacataataggtttgctgtacaagagttggagaatcttgaacatgccttgcacaaagtcaaagaaatgctggttcaaaggaagagtgaggagctgggtctagaaaaaactgaatgttga

SEQ ID NO: 81 - DNA, 807 bp, Medicago truncatula
  misc_feature (1)..(807): Mtruncatula3g071980_MtPDH
atgtcatcatcttccaaaagtctgaaaattggcatagttgggtttggcacctttggccaatttttggcaaatacaatgattaaacaaggtcatactctaactgcaactagtagaacagattactctcaactttgtgatcaaatgggaatccatttcttcagggatattacagcattccttgatgctgatatggatgtcatattgttatgcacatctatttcatcactatctgaggttgtcggatcgatgccactcgcttgtctgaagcgaccaacactttttgttgatgttctttcagtcaaagagcacccaaagaaccttctattaaaggtattgccagaggagtcagacatactctgcacgcacccaatgtttggaccagtgagtgggaaaaacggctggcaaaatctgactttcatgtttgataaagttcgaataaaggatgaagttacatgctctaaatttcttcaaatttttgcaagtgagggttgcaagatggtagaaatgtcatgtgaggaacatgacaaagcagctgcaaagagtcaatttatcacacacacaataggaaggacattggcagaaatggatattaaatccactcctattgacaccaagggctttcaaacacttgttgagttgaaaaaacctgtcatgggttgtagttttgatctgtatagtggattattcgtgtacaacagattcgccagacaagagctggaaaaccttgaacatgctctacacaaagtcaaagagatgctcgtccaaaggatcgatgaaggacagaacccagaaagaactgagagttga

SEQ ID NO: 82 - DNA, 807 bp, Medicago truncatula
  misc_feature (1)..(807): Mtruncatula3g071980_MtPDH C220D
atgtcatcatcttccaaaagtctgaaaattggcatagttgggtttggcacctttggccaatttttggcaaatacaatgattaaacaaggtcatactctaactgcaactagtagaacagattactctcaactttgtgatcaaatgggaatccatttcttcagggatattacagcattccttgatgctgatatggatgtcatattgttatgcacatctatttcatcactatctgaggttgtcggatcgatgccactcgcttgtctgaagcgaccaacactttttgttgatgttctttcagtcaaagagcacccaaagaaccttctattaaaggtattgccagaggagtcagacatactctgcacgcacccaatgtttggaccagtgagtgggaaaaacggctggcaaaatctgactttcatgtttgataaagttcgaataaaggatgaagttacatgctctaaatttcttcaaatttttgcaagtgagggttgcaagatggtagaaatgtcatgtgaggaacatgacaaagcagctgcaaagagtcaatttatcacacacacaataggaaggacattggcagaaatggatattaaatccactcctattgacaccaagggctttcaaacacttgttgagttgaaaaaacctgtcatgggtgatagttttgatctgtatagtggattattcgtgtacaacagattcgccagacaagagctggaaaaccttgaacatgctctacacaaagtcaaagagatgctcgtccaaaggatcgatgaaggacagaacccagaaagaactgagagttga

SEQ ID NO: 83 - DNA, 801 bp, Medicago truncatula
  misc_feature (1)..(801): Mtruncatula5g083530_MtncADH
atgtcaaattcaccttctctgaaaattggcatagttggatttggttcctttggtcaatttctggcaaagactatgatcaaacaaggccacactctaactgcaacttcaagaactgattactctcacacatgtctccaattgggcattcaattcttcagggatgttggaacattcattgaggctaacaatgatgtcatactcatatgcacatccattatgtcttttactaaggttctcagctctatgccacttgcttgtcttaagaaaccaacaacactctttgttgatgttctttcagtcaaagaacacccaagagaagttttattgcgggttctgccagaggagtcggatatactctgcacacacccaatgtttggaccagaaagtggaaagaatgggtggaaagatctcaattttatgtatgataaagttagaatacacgatgaagctacctgctctaatttcctccatatttttgctagtgagggttgtaagatgctacaaatgtcctgtgaagagcatgataaaatagctgcaaagagccaatttataacacacactataggcaggacattggcagaaatggacattgagtccacacctattgatacaaaaggctttcaaacacttactcaactgaagaacaccaccatgagagatagttttgatctgtacagtggattgtttgtacataacagattcgctaagcaagagctggaaaacctccaacgtgccttggacagagttaaagagatgctggttcaaaggatgagagaggaactgggtccagaaaaagactga

SEQ ID NO: 84 - DNA, 801 bp, Medicago truncatula
  misc_feature (1)..(801): Mtruncatula5g083530_MtncADH D220C
atgtcaaattcaccttctctgaaaattggcatagttggatttggttcctttggtcaatttctggcaaagactatgatcaaacaaggccacactctaactgcaacttcaagaactgattactctcacacatgtctccaattgggcattcaattcttcagggatgttggaacattcattgaggctaacaatgatgtcatactcatatgcacatccattatgtcttttactaaggttctcagctctatgccacttgcttgtcttaagaaaccaacaacactctttgttgatgttctttcagtcaaagaacacccaagagaagttttattgcgggttctgccagaggagtcggatatactctgcacacacccaatgtttggaccagaaagtggaaagaatgggtggaaagatctcaattttatgtatgataaagttagaatacacgatgaagctacctgctctaatttcctccatatttttgctagtgagggttgtaagatgctacaaatgtcctgtgaagagcatgataaaatagctgcaaagagccaatttataacacacactataggcaggacattggcagaaatggacattgagtccacacctattgatacaaaaggctttcaaacacttactcaactgaagaacaccaccatgagatgtagttttgatctgtacagtggattgtttgtacataacagattcgctaagcaagagctggaaaacctccaacgtgccttggacagagttaaagagatgctggttcaaaggatgagagaggaactgggtccagaaaaagactga

SEQ ID NO: 85 - DNA, 2073 bp, Medicago truncatula
  misc_feature (1)..(2073): Mtruncatula4g115980
atgctcggcgtttcaaccttccactcgacgtcgttgaaaacgccgtcgcattcaaccaccactcgcctgaaccctacatttcctttctccatctccatttccccctctttcaatcgttccaccaccacaaaacccctcaccatccgtgcaatcgacgcagctcaatcattcgactacgaatccaaaatcgcacttcaattccacaactctcaaaagctcaaaatcgccatcatcggttttggtaacttcggtcaattcctcgccaccactttcgtccgtcaaggtcacactgttttagctcattcccgttccgattactccgccgtcgctcaaaacatcggtgtcaaattcttccccaacgccgatgatctctgtgaagaacaccccgaagttattcttctctgcacttcaataatctcagcacaacaagttctactttctcttccatttcaacgactcaaacggagtacattgttcgttgatgttctttccgtcaaggaatttcctaaaaacttttttctcgaaattttacctaattatttcgatataatttgttcgcatcctatgtttggacctgagagtggaagcagtggctggaaaggtcttccctttgtttacgaaaaagttcgaattgggaacaatgaaactagggtttcgaggtgtgagaagtttcttgatgtgtttggaagagaaggatgtagaatggtggaaatgagttgtgctgatcatgatagatatgctgctgggtcacaattcataacacatactgttggtagggttttgggtatgttgacgttggaatctactcctattaatactaaagggtatgaatctttgttgaatttggtggagaatactagtggggatagttttgatctttattacggactttttatgtttaataagaattctttggagatgttggagaggttggatttagcttttgaggatttgaggaaacagcttattgctcatttgcatgatgttgtgaggaatcagttgtttgaagatgctgtaaaggtccaaaatttgggtgatgatagcaaccatgtagccagaaagcatggtcaaaatggatcagcaattgtgttatcctccaaaaatcagagatctgctgatgccagactacatggttattacagatcaaatggttctggccagtcggatgacagcacaaagctcaaaattgcaatcattggttttggcaacttcggtcaattccttgcaaaaactattgtacgtcatgggcataaagtgttagcatactctagaacagactactctgatgtggctcgggaattgggagtttcctatttcaacgatgcagatgatctttgtgaacaacatccagaagtgattttactttgcacttcaatcctttccacagaaaaagttcttaaatcattgcctgtgcagaggttgaggagaagtactttgtttgttgatgtactttctgtcaaagagtttcctagaaacttgtttcttcaacatttgccaccttattttgacgttctctgcactcaccctatgtttgggcctgagagtggaaaaaatgggtggaagggtcttccttttttatttgataaagtcagagtaggaagagatgaatcaagaatatcgcggtgtgatctgtttcttgacattttttccaaagaagggtgcagaatggttgaaatgtcatgtgccgaacatgattggcatgccgctggatcacagtttatcacacataccacaggaagatttttagaaaaactgaagttggaggcaacaccaatagacacaaagggctatgaaactttattaagtttggtggagaatactggtggggatagctttgatctgtactatggtttgttcttgtataatataaatgccatggagcaactgcaaagatttgatctggcttttgagtcattgaagaagcagctttttgaccgtttacatggtatctatcgaaaacaggtatttcaaaatgaagaaaaagtccgtgattttccagagagatctatgttgcctgagaaatcagaagacagtagtgtggtatctttttcaaataccgtggatgctaaatga

SEQ ID NO: 86 - DNA, 2196 bp, Proteus vulgaris
  misc_feature (1)..(2196): Pvulgaris03g178200
atggtggctgtttcaacctttcaggcgccgtcattaccgaaggcttcaacttcattgtcttcaacaattatttgcggaaatctcaaactcaactttcttccattctcctctcccaaagccttctcttcaggcgttcgcgtccacaggcccctccgcattcgcgccatcgacgcggcccagcccttcgattacgagtcaagagtggcccaacagttccacgatgcccagaggctgaagatcgccatcgtgggcttcggcaactacggccagtttctggcccaaaccctcgtccgacagggccacaccgtcctggcccattcccgctccgactacaccgacgcggcccgcaaactcggtgtcacgtttttccacaacccgcacgacctctgcgaggagcaccccgaagtcatcctcctctgctcctccatcatctcaacccagcgcgtgctcctcactctcccactccaaagcctcaaacgcagcacgctcttcgtcgatgttctttccgtcaaggagttccccaaaaatctcttgctccatgctctcccctccgatttcgatatcctatgcacgcaccccatgttcggtccccaaagcgcgcctcgcgcgtgggccggcctcccctttgtcttcgagaaggttcgaattggcgacgacgaccgccgaatcgagcggtgcgacaagttcctcaacatcttcgcgagggaagggtgccgaatggtggagatgtgttgcgccgatcacgatatgttcgccgcggggtcgcagttcatcacgcacaccgttgggagggttttggagatgctgatgttggagtccactccgattaacaccaagggttacgagtctttgttcaatctggtggagaacactgctggggatagttttgatctctactacgggttgtttatgtttaataagaattcactggagatgttggagcggttggatttcgcgttcgaggatttgcggaaacagctcatggggcggttgcatggtgttgtgaggcagcagttgtttgataatgctgggattggaaaggggcagagtttaccagatgactatgtgtataagctgctcaagaaggctcaaaatggatcagcacctgtgctgtcactaccctccaaagaacacagatccgatgatgttgctaaacttgacaaatacaacacaaatgattcaagccagtctgcagacaactcaaaactcatgaatgctctaaatggatttgcaccggtactatcacgggtctccaaagaacttagattcattgatgtgactgaactcaacaaatacaagccaaatatttcaagccaatctgaagacagcacaaagctgaagattgcaattattggtttcggcaattttggtcagtttcttgcaaaaagtattgtgcgtcaaggtcataaagtgttggcatactctagatcggactactctcgtgtggctgaggaaatgggggcttcgtattttaataatgttgatgatctttttgaacaacatccagaagtgattttactttgcacttcaatcctttccacagagaaagttcttaaatcattgcccgtgcagagattgaaaagaagtactttatttgttgatgtactttctgtcaaagaatttcctagaaatttgtttcttcaacatttgtcacatgattttgatattctctgcacgcatcctatgtttgggccagagagtggaaaaaatgggtggaacggtcttgcttttgtttatgataaagttagaataggaacagatgaatcaagaacttcacgatgtgatcggtttctggacattttttctagggaagggtgccgaatggttgaaatgtcatgtgcagaacatgattggcatgcagctggatcacaatttatcacgcatactacaggaagatttttagaaaaactcaagttggaggcaacgccaattgacacaaagggttacgagacattgttgagtttggtcgaaaatactgctggagatagttttgatctgtactatggattgttcttgtataatgcaaatgccatggagcaactagaaagattcgatctggcttttgagtcattgaagaagcggctttttgatcgtatgcatgctttctaccgacagcaagtgtttgaacatgaagaagaaaaactccaaaatttgtcagagaggcgtatgttgcccaagggatctgaagaaaaataa

SEQ ID NO: 87 - DNA, 810 bp, Proteus vulgaris
  misc_feature (1)..(810): Pvulgaris01g247200
atgtcatcatcatcatcttcttcccaaagcctcaaaattggcatagttggattcggcacctttggccaatttctggccaagacaatgataaaacaaggccactctctcactgcaacttctcgatccgattactccgacctctgtctccaaatgggcattcatttttacggggatgttacagcatttcttgcttctgacatagatgtcatagtgttgtgcacatcgatattatcgctatccgaagttgtggggtcaatgccactcgcttccctgaagcgcccaacactctttgttgatgttctttcagtcaaagagcacccaagagagcttctgctacgagagttgccagagcactcagacattctctgcactcaccctatgtttggacctgtcagtggcaagaatggatggaaaggtctcactttcatgtatgacaaagttcggattagaaatgaagctatctgctctagtttcatccaaatttttgccagtgagggttgcaagatggtgcaaatgacttgtgaggaacatgacaaagcagctgcgaagagccaatttatcacacacacaattggcagaacattggcagaaatggatattaaatccacacctattgacactaagggctttgaggaacttgttaaattgaaggagacgatgattggaaatagttttgatttgttcagtggattattcgtgtacaacagattcgccagacaagagctggaaaaccttgaacatgccttgcaaaaagtcaaagaaacgctggttgaaaggaagaacgaggagcagggtcaagaaaagaactga

SEQ ID NO: 88 - DNA, 2043 bp, Fragaria vesca
  misc_feature (1)..(2043): Fvesca30772
atgccacctctctctctccaccctttccctccaaaactcatccccactccctctctcctcttcaacccccaaagccccaacctttacccccaaagctcccacctttattatcacacccccaattcaaccccaaaacgacgccgttttggtctccaaatcaaatccctagacgccgcccaggttttcgactacgaatccaagctcgccgcccagttccgctcctcccaaaccctcacaatcgccatcatcggcttcggcaacttcggccagttcctcgccaaaaccctaacccgccaaggccacaccgtcctcgcccactcccgctccgaccactccgccgccgccgccaaactcggcgtctccttcttccccgacccccacgacctctgcgagcagcacccccacgtcatcctcctctgcacctccatcatctccgccgccgccgtcctctcctccctccccgtccagcgcctccgccgcagcacgctcttcgccgacgtcctctccgtcaaggaattctccaaagctctgttcttgaatgcgcttccgccctacttcgatttgatctgcactcaccccatgttcggccctgaaagcgcgaaagagagctggaatgagctgcatttcgtgttcgaaaaggtccgaatcggagaagaaggctccagggctgagaggtgtgagaagttcttgagcattttcgagagggaagggtgtaagatggtggaaatgagctgtgtagagcatgataagtatgccgcggggtcgcagtttattactcacactgttgggagggtgctggggatgctgaggctggagtcgacgccgattaataccaaagggtatgagacattgttggatttggtggagaacactgcaggggacagctttgatttgtattacgggttgtttgtgtataacaagaatgcgctggatatgctggagaggctggactcggcttttgaggctttgaaggcgcagcttttcgggaggctgcatgatgttgtgaggaaccagttgtttggcaatgccgggaaggtgaggccgttgcaggaggagaatgtgaatcagaatggcgctgcattggtgcgttcttcaattgctgggagacccctcaaagtacatgttctggatagctctggagacgacaattcgatgctcagggttggaattgttggttttggcaactttggtcagttccttgccaaaaccattgtacgccaaggtcacaaggttctagcctattcgcggtcagactactctgatgttgctcgactgttgggtgtttcttacttctcggatgcagatgatttttgtgaggagcatccagaagtaataatcctctgcacatcgattctctccaccgagaaagttctgatgtcactccctcttcagaggttgaagcggagtactttgtttgttgatgttctatctgtgaaggaatttccgagaagcctgtttcttcaaaggttgcctccatattttgatattctctgcacacatcctatgtttggaccagaaagtgggaaaaatgggtggaatggtcttgcttttgtgtatgatagggtcaggattggaaatgaagaatcaagggtgtcaaggtgtgatcaatttcttgatatttttgctcaagaagggtgtcgtatggtgcaaatgtcatgcgaagagcatgataagcatgcggcagggtcacaattcatcacacacactatgggaagaattttggaaaagttgggtttggagtcgacgccggtcaatacaaaaggttacaagactttgttgaatttggttgagaatacagcaggagatagctttgatctctattatggattgttcatgtacaatgcaaatgcaatggagcagctaaagaggctggacaatgcttttgaagcattaaaaaaacagctttttgggcgtttgcatggtgtttcacggaagcagattttcgagaatgaagatgattctcaacatttgttgccaacaccatcagagaatgaatctgcatctacatcttctttggaggctctcaacattcagaacaactaa

SEQ ID NO: 89 - DNA, 1965 bp, Fragaria vesca
  misc_feature (1)..(1965): Fvesca17779
atgtcgttgcgtggccttttaatggcttcaacttttgagaagacgacacatattaaccccagcatcacatcttcatcagatgaggccgggtacacgtgtaagtgtaaccaacattcgtcgtcgatggtgatcacagtggtggcagtgacacagaattctgaatttctcacagaattccacaacgttcaaatgctcaagattgccatcatcggctttggcaacttgggtcaatcccttgccaagacctttgcccacctaggacacattgttcttgcacattctagatgtgaacactccaaaatggcccaagacctcggcatttcatatttttctaacccgcaagaactctgtgaacagaatccacaggtcattttgctatgcacctccataatatccacagaatccgtcctcaaatctttacctcttcagagccttacacatgacacattgtttgttgacatgcttcctgtcaaggagttttcaaaagctttgttactgaagatgttgcctagcaatctagctgttgtttgcaccaacccgatgttcggagttgaaagaggcaaacatgagtggaatggcagttttttggtgtacgaaaaggttcgaattggctctgacagtgtggggatttcgttgtgtgataacttcttaaacatctttgagaaagaaggatgtagaatggtggaagtaagctgttctgttcaagataagtatgtagcaggctcgcagtttattacccacacagttgggagagtcttggaaaagttaacattggaatcgacgccaataaatacaaaaggttatgagacattgttggatttggtggacaacacagctggggatagctttgatttatattgtgagttgttcatatacaataaaaatgcatttgagatgtttgacaggttggacttggcttttaacactttgaagaagcaactttttggtcatttgcatgatattgtgagaaagcaactatttgatagtgcagagaaggtacatgcggagtacatggtgtgtaatccatcccacaatggagctgccttgaggtcgcattctcaggtacttaaccaaaaagcacatatatctgaacactatgatgacaagtcgatgctcaagattgcaattgttggttttgggaacttcggtcagttccttgctaaaactattatacgtcaaggtcataaagttctagcctattctcgatcagactactatgatgtggctcaagagatgggggtaatttacttatccgacgttgaggctctttgcgaagagcatccagaagtgatgctcttttgtacctctatcctttcaaccgagaaagttctcagatcatttccagttcagaggttgatgaggaatacattgtttgttgatgtgctttcagttaaagaatttccaagaaacttgtttcttcaaaagttgccgttggattttgatattctctgtacgcatcctatgtttggaccagagagtggtaaaaatgggtggaatgctcttccttttgtttatgataaggtcagggtgggaagtgataaatcaagggtatcactctgtgaccgattccttgatatctttgctctagaagggtgccgaatggttgaaatgtcttgttcagagcatgataggcatgcagcagggtcacaattcattacgcacaccataggaagggttttggaaaagctgggtttggagtcaacacctatccttccaaatggttacaaggctttattgaatttggtggagaatacagtaggagatagttttgatctttaccatggcttgttcatgtataatgtaaatgcaatagaccagctgaatagattggacatggcttttaactcgttaaaggaacagtttttgaggcgtttgcatggtgttgtccatagccaacatttcgagaatgcaagcagaaccttgttgccaaatcatccagagaatgcagctccactgagaagatga

SEQ ID NO: 90 - DNA, 1923 bp, Arabidopsis thaliana
  misc_feature (1)..(1923): Athaliana5g34930.1_AtADH1
atggcagagacactcatcaccaaacctcctctctccctctcatttacctctctttcctcaatgctcccttctctctctctctccaccgccaaccgccacctctccgtcaccgacaccatccctcttcccaactccaactccaacgccacccctcctctccgtatcgccatcatcggattcggaaactacggccaattccttgccgaaaccctaatttctcaaggccacattctcttcgctcactcccgatccgatcactcctccgccgctcgccgtctcggtgtctcatacttcaccgatcttcacgatctctgcgaacgtcatcctgacgtagtccttctctgtacttcaatcctctccatagagaatattctcaaaacgttgccgtttcagagactccgtcgcaacactctcttcgttgatgttctctccgttaaagagtttgctaaaactcttctccttcaatacttacctgaagatttcgatattctttgtacacatccaatgtttggtcctcagagtgtgagttcaaatcatggctggagaggattaagatttgtgtatgataaagttaggattggggaagagagattgagagtctcaaggtgtgagagttttcttgagatttttgttagagaaggatgtgagatggtggagatgagtgttactgatcatgataagtttgctgctgaatcacagtttataactcatactcttggtaggcttttggggatgttgaagttgatatcgacgccgattaatacgaaagggtacgaggcgttgcttgatttagctgagaatatttgtggggatagttttgatttgtattatgggttgtttgtgtataataacaactctttggaggtgttagagaggattgatttggctttcgaggctttgcgtaaggagctttttagtcggcttcacggtgttgtgaggaagcagtcttttgaaggtgaagcaaagaaagttcatgtttttccaaattgtggtgaaaatgatgcttctttggatatgatgaggtcagaagatgttgttgtgaagtatgaatataactcccaggtgtctggtagtgttaatgacggttcgaggctcaagattggtatcgtcgggtttggaaattttggacagtttctaggtaaaaccatggtcaagcagggtcacactgtgttagcttattccagaagtgactacactgatgaagcagcaaagctcggtgtttcgtatttttcagatcttgatgatctatttgaagagcatcctgaagttattattctctgtacgtcaatcctttcgactgaaaaagttctcgagtcactaccgtttcagagactgaagagaagcacactttttgtggatgtactctcagtaaaagagttcccgaggaatttatttcttcaaactctcccacaagattttgatattttgtgcacgcatcctatgtttgggccagagagtggtaaaaatggatggaacaatcttgcctttgtgtttgataaggttaggattggaatggatgatagaagaaaatcgaggtgtaacagttttcttgatatttttgcccgtgaaggatgtcgtatggtggagatgtcgtgtgctgaacatgattggcatgctgctggatcacagtttatcacacacacagtgggaaggcttctggagaagctgagcttggaatctactcctatagataccaaaggttatgagacattgctaaaactggtggagaatactgctggtgacagctttgatctgtactatggactatttttatacaatcctaatgcaatggaacagcttgagaggtttcatgtggcttttgaatcattgaagacacagctctttggacgactacattctcaacattctcatgagctagctaaatcatcttccccaaagacaactaagctattaactagctaa

SEQ ID NO: 91 - DNA, 1077 bp, Arabidopsis thaliana
  misc_feature (1)..(1077): Athaliana1g15710.1_AtADH2
atgctactccatttctctccggcgaaacccctcatttctccacccaatctccgccgcaattcacccacattcctcatttccccgccgcgatctcttcgaattcgagcaatcgacgccgcccaaatcttcgattacgaaacccaactcaaatccgagtaccgcaaatcctctgctctcaaaatcgccgtcttgggtttcggcaatttcggccaattcctctccaaaaccctaattcgacacggccacgatctaatcactcactcccgctccgattactccgacgccgcaaactcaatcggagctcgtttcttcgataaccctcacgatctctgtgaacaacatcccgacgttgtcctcctctgtacctcaatcctctccacagaatcagtcctcagatcattccctttccaacgtctccgtcgtagcacactcttcgtcgatgttctctccgttaaggaattcccaaaagccctcttcattaaataccttcctaaggagtttgacattctctgtactcatccaatgtttggacctgagagtggtaagcattcttggtctggcttgccctttgtctacgataaggtgagaatcggagacgcagcttcaagacaagagaggtgtgagaagtttctaagaatttttgagaatgaaggttgcaagatggttgaaatgagctgtgagaagcatgattattacgcagctggatcgcaattcgtgacgcatactatgggaagggttttggagaaatatggagttgagtcttcgccgattaacaccaaaggttatgagacgttgttggatttggtggagaacacatcgagtgatagctttgagcttttctacggtttgtttatgtataatccgaatgctcttgaacagttggagagattggatatggcttttgagtctgttaagaaggagctgtttgggagattacatcagcaatacaggaagcaaatgtttggtggggaggttcaatcgcccaagaaaactgagcagaaattgctcaatgatggtggtgttgttcctatgaatgatatatcatcatcatcatcatcatcatcatcatcatcttaa

SEQ ID NO: 92 - DNA, 975 bp, Arabidopsis thaliana
  misc_feature (1)..(975): Athaliana1g15710.1_AtADH2 D241N
atggcaatcgacgccgcccaaatcttcgattacgaaacccaactcaaatccgagtaccgcaaatcctctgctctcaaaatcgccgtcttgggtttcggcaatttcggccaattcctctccaaaaccctaattcgacacggccacgatctaatcactcactcccgctccgattactccgacgccgcaaactcaatcggagctcgtttcttcgataaccctcacgatctctgtgaacaacatcccgacgttgtcctcctctgtacctcaatcctctccacagaatcagtcctcagatcattccctttccaacgtctccgtcgtagcacactcttcgtcgatgttctctccgttaaggaattcccaaaagccctcttcattaaataccttcctaaggagtttgacattctctgtactcatccaatgtttggacctgagagtggtaagcattcttggtctggcttgccctttgtctacgataaggtgagaatcggagacgcagcttcaagacaagagaggtgtgagaagtttctaagaatttttgagaatgaaggttgcaagatggttgaaatgagctgtgagaagcatgattattacgcagctggatcgcaattcgtgacgcatactatgggaagggttttggagaaatatggagttgagtcttcgccgattaacaccaaaggttatgagacgttgttggatttggtggagaacacatcgagtaatagctttgagcttttctacggtttgtttatgtataatccgaatgctcttgaacagttggagagattggatatggcttttgagtctgttaagaaggagctgtttgggagattacatcagcaatacaggaagcaaatgtttggtggggaggttcaatcgcccaagaaaactgagcagaaattgctcaatgatggtggtgttgttcctatgaatgatatatcatcatcatcatcatcatcatcatcatcatcttaa

SEQ ID NO: 93 - DNA, 1209 bp, Arachis ipaensis
  misc_feature (1)..(1209): AipaensisVYE8T_Peanut PDH/ADH
ccttttagttaacaatttaagcttgatgaaaaactaagggtgagagatgggttaggtggtagtactttttttttaaccttttcaattaactatataaagggccaattcaccctagatcaccataacgaatagccgccacaagtaggagtggttgatacttgatagtaataactaatacacgcaccattgttctttgggacattatccacactttcactaaaccatgtcatcttcccattcccaaaacatgaaaataggcatagtgggtttcggcaccttcggacagtttcttgcaaagacaattataaaacaaggccacactataacggcaacttctcgatcagattactcccatctctgcctccaaatgggtatccattttttcagggatatgagtgcattccttgatgctgggaacgatgtaatactgttatgcacatcgatcttatcgctagcggaagttatgaggtcaatgccactcacttgtctgaagcgaccaacgctctttgttgatgtcctttcggtcaaagaacatcctagaaaccttctactccgaacgttgccaggggagttagacatactgtgcacgcacccaatgtttggaccaatcagtgggaaggatgggtggaaagatctcactttcatgtatgacaaagttcgaattcaagatgaagccaaatgctctcgtttcctccaaatttttgaaactgagggttgcaggatggtagaaatgtcctgtgaggaacatgataaagcagctgctaggagccaatttatcacacacacaataggcaggacattgggagaaatggatataaggtccacacctattgacactaagggctttgagacacttgttcaattgaaggagaccaccatgaaatgtagttttgatctgtacagtggattgttcacgcataacagatttgccatacaagagctggaaaaccttgagcatgccttgttcaaggtcaaagagatgctggttcaaatgatgaaagaggagcagggtcaagaaaaaactgaaagttgatgtattacttgtacttgagcaaaagaaattatataaaaaaaagaagtggaaagaaagaaacaaaagaaatagatacattcaatcacttgtaataaataggttccattcccaatacatgctcagtaatttcaatattagtaaagcatacatttattcccaatgcctggaagaatcca

SEQ ID NO: 94 - DNA, 813 bp, Arachis ipaensis
  misc_feature (1)..(813): AipaensisP6A5Q
atgtcatcatcatcatcatcatcagctctcaaaattggcatagttggattcggcacctttggccagtttctggcaaagactatgatcaaacaaggccacactcttacagctacttcaagaactgattactcccaacactccctccaacctggcatccaattcttcagggatgtgaatgaattccttgaggctgataatgatgtcatactcatatgcacatccattatttctttatctggggttcttgattctatgccaatttcttctctgaagcgatcatcaacactctttgttgatgttctttcagtcaaagagcacccaagagaacttcttctgcggaaattgccagaggaatcagacattctctgcactcatcccatgtttggcccagaaagtggtaaaaatgggtggaaggatctcactttcatgtacgataaagttcgaattcgagatgaagttatctgctctaatttcctcaatatttttgcaaccgagggttgcaggatgctacaaatgacatgtgaagaacatgataaacttgctgctaagagccaatttatcacacacactataggaaggacattggcagaaatggatgctaaattcacacctattgatacaaagggctttcagacacttgttcaattgaaggacagcaccatgagagatagttttgatctgtatagtggattattcttgcataacagatttgctagacaagagctggaaaacctagaacatgccctacacaaagtgaaagagatgctggttcaaaggatgagtgatgtgctgggtacagagaagactgcataa

SEQ ID NO: 95 - DNA, 813 bp, Arachis duranensis
  misc_feature (1)..(813): AduranensisP7PS3
atgtcttcatcatcatcatcatcatctctgaaaattggcatcattgggttcggcacctttggccagtttctggcaaagactatgatcaaacaaggccacactcttacagctacttcaagaactgattactcccaacactccctccaacttggcatccaattcttcagggatgtgaatgaattccttgaggctgataatgatgtcatactcctatgcacatccattatttctttatctggggttcttgattctatgccaatttcttctctgaagcgatcatcaacactctttgttgatgttctttcagtcaaagagcacccaagagaacttcttctgcggaaattgccagaggaatcagacattctctgcactcatcccatgtttggcccagaaagtggtaagaatgggtggaaggatctcactttcatgtacgataaagttcgaattcgagatgaagttatctgctctaatttcctcaacatttttgcaaccgagggttgcaggatgctacaaatgacatgtgaagaacatgataaacttgctgctaagagccaatttatcacacacactataggaaggacattggcagaaatggatgctaaattcacacctattgatacaaagggctttcagacacttgttcaattgaaggacagcaccatgagagatagttttgatctgtatagtggattattcttgcataacagatttgctagacaagagctggaaaacctagaacatgccctacacaaagtgaaagagatgctggttcaaaggatgagtgatgtgctgggtacagagaagactgcataa

SEQ ID NO: 96 - DNA, 1255 bp, Arachis duranensis
  misc_feature (1)..(1255): AduranensisL1RYW
gacttgccttttggttaacaatttaagcttgatgaaaaactaagggtgagatggttaggtggtagtactttttttctttttaaccttttcaattaactatataaagggccaattcaccctagatcaccataacgaatagccgccacaagtaggagtggttgatacttgtgtgatagtaataacacaccattgttcttcacttctttgggacattatccacactttcactaaaccatgtcatcttcccattcccaaaacatgaaaataggcatagtgggtttcggcaccttcggacagtttcttgcaaagacaattataaaacaaggccacactataacggcaacttctcgatcagattactcccatctctgcctccaaatgggtatccattttttcagcgatatgagtgcattccttgatgctgagaacgatgtaatactgttatgcacatcgatcttatcgctagcggaagttatgaggtcaatgccactcacctgtctgaagcgaccaacgctctttgttgatgtcctttcggtcaaagaacatcctagaaaccttctactccgaacgttgccaggggagttagacatactgtgcacgcacccaatgtttggaccaatcagtgggaaggatgggtggaaagatctcactttcatgtatgacaaagttcgaattcaagatgaagccaaatgctctcgtttcctccaaatttttgaaactgagataaaagttaaaaaatcgaatgatgatgacccaaacctggtgatgaattcaagcaaggtcaattattattttcgcatgtacattgtatgtattacacagggttgcaggatggtagaaatgtcctgtgaggaacatgataaagcagctgctaggagccaatttatcacacacacaataggcaggtacatgaaggagaccaccatgaaatgtagttttgatctgtacagtggattgttcacgcataacagatttgccatacaagagctggaaaaccttgagcatgccttgttcaaggtcaaagagatgctggttcaaaggatgaaagaggagcagggtcaagaaaaaactgaaagttgatgtattacttgtacttgagcaaaagaaattatataaaaaaagaagtggaaagaaagaaacaaaagaaatagatacattcaatcacttgtaataaataggttccattcccaatacatgctcagtaatttcaatattagtaaagcatacatttattcccaatgcctggaagaatcca

SEQ ID NO: 97 - DNA, 36 bp, Artificial Sequence
  Synthetic
ggagacgacgatgagaaatagttttgatttgtatag

SEQ ID NO: 98 - DNA, 37 bp, Artificial Sequence
  Synthetic
caaaactatttctcatcgtcgtctccttcaatttaac

SEQ ID NO: 99 - DNA, 36 bp, Artificial Sequence
  Synthetic
ggagacgatgatgagagatagttttgatttgtatag

SEQ ID NO: 100 - DNA, 37 bp, Artificial Sequence
  Synthetic
caaaactatctctcatcatcgtctccttcaatttaac

SEQ ID NO: 101 - DNA, 36 bp, Artificial Sequence
  Synthetic
ggagacgatgatgagagctagttttgatttgtatag

SEQ ID NO: 102 - DNA, 37 bp, Artificial Sequence
  Synthetic
caaaactagctctcatcatcgtctccttcaatttaac

SEQ ID NO: 103 - DNA, 36 bp, Artificial Sequence
  Synthetic
ggagacgacgatgagagatagttttgatttgtatag

SEQ ID NO: 104 - DNA, 37 bp, Artificial Sequence
  Synthetic
caaaactatctctcatcgtcgtctccttcaatttaac

SEQ ID NO: 105 - DNA, 36 bp, Artificial Sequence
  Synthetic
aggacaccaccatcagaaatagttttgacttgtaca

SEQ ID NO: 106 - DNA, 35 bp, Artificial Sequence
  Synthetic
aaaactatttctgatggtggtgtccttcaattgaa

SEQ ID NO: 107 - DNA, 40 bp, Artificial Sequence
  Synthetic
gtcatgggtgatagttttgatctgtatagtggattattcg

SEQ ID NO: 108 - DNA, 40 bp, Artificial Sequence
  Synthetic
gatcaaaactatcacccatgacaggttttttcaactcaac

SEQ ID NO: 109 - DNA, 35 bp, Artificial Sequence
  Synthetic
cgcgcggcagccatatgtcaaattcaccttctctg

SEQ ID NO: 110 - DNA, 36 bp, Artificial Sequence
  Synthetic
gacggagctcgaattcatgcatcaacattcagtctt

SEQ ID NO: 111 - DNA, 39 bp, Artificial Sequence
  Synthetic
ccatgagatgtagttttgatctgtacagtggattgtttg

SEQ ID NO: 112 - DNA, 40 bp, Artificial Sequence
  Synthetic
caaaactacatctcatggtggtgttcttcagttgagtaag

SEQ ID NO: 113 - DNA, 37 bp, Artificial Sequence
  Synthetic
cgcgcggcagccatatgtcatcttcccattcccaaaa

SEQ ID NO: 114 - DNA, 36 bp, Artificial Sequence
  Synthetic
gacggagctcgaattctcaactttcagttttttctt

SEQ ID NO: 115 - DNA, 37 bp, Artificial Sequence
  Synthetic
cgcgcggcagccatatgatgtcttcatcttcttcttg

SEQ ID NO: 116 - DNA, 37 bp, Artificial Sequence
  Synthetic
gacggagctcgaattcttagaactttgatatgatagg

SEQ ID NO: 117 - DNA, 34 bp, Artificial Sequence
  Synthetic
gctcagttaaaaatagttttgatctgttcagcgg

SEQ ID NO: 118 - DNA, 34 bp, Artificial Sequence
  Synthetic
gatcaaaactatttttaactgagctctccttcac

SEQ ID NO: 119 - DNA, 33 bp, Artificial Sequence
  Synthetic
cacatcgagtaatagctttgagcttttctacgg

SEQ ID NO: 120 - DNA, 36 bp, Artificial Sequence
  Synthetic
ctcaaagctattactcgatgtgttctccaccaaatc

SEQ ID NO: 121 - protein, 271 aa, Artificial Sequence
  Synthetic: 5T8X
MSTSSSSQSLKIGIVGFGNFGQFLAKTMIKQGHTLTATSRSDYSELCLQMGIHFFRDVSAFLTADIDVIVLCTSILSLSEVVGSMPLTSLKRPTLFVDVLSVKEHPRELLLRELPEDSDILCTHPMFGPQTAKNGWTDHTFMYDKVRIRDEVICSNFIQIFATEGCKMVQMSCEEHDRAAAKSQFITHTIGRTLGEMDIQSTPIDTKGFETLVKLKETMMRNSFDLYSGLFVYNRFARQELENLEHALHKVKETLMIQRTNGEQGHKRTES

SEQ ID NO: 122 - protein, 271 aa, Glycine max; identical to SEQ ID NO: 121
  misc_feature (1)..(271): G. max 18g023100

SEQ ID NO: 123 - protein, 268 aa, M. truncatula
  misc_feature (1)..(268): M. truncatula 3g071980
MSSSSKSLKIGIVGFGTFGQFLANTMIKQGHTLTATSRTDYSQLCDQMGIHFFRDITAFLDADMDVILLCTSISSLSEVVGSMPLACLKRPTLFVDVLSVKEHPKNLLLKVLPEESDILCTHPMFGPVSGKNGWQNLTFMFDKVRIKDEVTCSKFLQIFASEGCKMVEMSCEEHDKAAAKSQFITHTIGRTLAEMDIKSTPIDTKGFQTLVELKKPVMGCSFDLYSGLFVYNRFARQELENLEHALHKVKEMLVQRIDEGQNPERTES

SEQ ID NO: 124 - protein, 266 aa, M. truncatula
  misc_feature (1)..(266): M. truncatula 5g083530
MSNSPSLKIGIVGFGSFGQFLAKTMIKQGHTLTATSRTDYSHTCLQLGIQFFRDVGTFIEANNDVILICTSIMSFTKVLSSMPLACLKKPTTLFVDVLSVKEHPREVLLRVLPEESDILCTHPMFGPESGKNGWKDLNFMYDKVRIHDEATCSNFLHIFASEGCKMLQMSCEEHDKIAAKSQFITHTIGRTLAEMDIESTPIDTKGFQTLTQLKNTTMRDSFDLYSGLFVHNRFAKQELENLQRALDRVKEMLVQRMREELGPEKD

SEQ ID NO: 125 - protein, 265 aa, Glycine max
  misc_feature (1)..(265): G. max 14g055300
MSTWSLKIGVVGFGSFGQFLAKTMIKQGHTLRATSRTDYSLLCLPMGIQFFRDVAAFLEADNDVLVCTSILSLSEVLSSMPLTCLKRSTLFVDVLSVKEHPRNLLIKVLPEESDILCTHPMFGPDSGKDGWQDLTFVYDKVRIRDEAICSSFLHIFASEGCRMLQMSCEEHDKIAAKSQFITHTIGRTLAEMDIKSTPIDTKGFHSLVQLKDTTIRDSFDLYSGLFLHNRFAVQELENLEHALHKVKEMLVQRKSEELGLEKTEC

SEQ ID NO: 126 - protein, 272 aa, Solanum lycopersicum
  misc_feature (1)..(272): S. lycopersicum06g050630
MSSSSSCQPKTLRIGIIGFGPFAQFLAKTMMKQGHCIHVTSRSDYSELCTDLGILFFRDMGAFLESDNEVIMISTSILSLSQVVESIPFNCLKRPTLFVDVLSVKEHPKDVLLRMMPRECDLLCTHPMFGPESGKDGWEDLTFMYDMVRIRDQPLCSSFLHIFSSEGCKMLEMTCEKHDRLAAQSQFLTHTIGRILSEMEVEPTPIDTKGFQKLVQVKESSVKDSFDLFSGLFIHNRFARQQMKNLEVALEKTKEKLQERSKELQDPIISKF

SEQ ID NO: 127 - protein, 403 aa, C. reinhardtii
  misc_feature (1)..(403): C. reinhardtii 06g278350
MLRARPLAPSVPTCTSSSCSTSGASLVPILAAAECSTRTIAGAARSVPCRRVLGRRARGVRVLAIDAAQPFDFEHRMKQRISDKEKLKVGIVGFGTFGQFLAKRLVARGHQVIATSRSPYEDIAKKIGVEYYQDLDDFCEEHPEVVLLASSILSTEKVLRSVPVQRLKRNTLFVDVLSVKVFPKQLLLRELPSEVDILCTHPMFGPDSGKGSWAGLNFMYEKVRIGADPKRERRVETFLKFFRDEGCNMVEMTCEEHDRQAASTQFITHTVGRVLGTMQLRSTEINTKGFEALLNLVNNTNNDSFELYYGLFLYNQNATDELERLEQAFDTVKKQLFGRLHDIARQQLFPTVDSQGNGNGAAAPPPQALPPPREPLALPSRSRDEVMAQAPSDAYSASKTIDV

SEQ ID NO: 128 - protein, 437 aa, S. fallax
  misc_feature (1)..(437): S. fallax TyrA
MDRNCCEAIANTLQRKLSLMARTQGTWHGICFLPGGSASNSLAHSSSTAVTICGMTCCTKNTLQQLSWKLSSRSLCQDVVLHTKVRVPRKRNSSLEVAAIDAAQSFDYESLRMEELQSGNKLKIGIVGFGNFGQFLAQRMISQGHKVLAYSRTDYKDVAHTMGVPFFRDADDFCEEHPEVVLLCTSILSTEDVLKLLPVQRLKRNTLFVDVLSVKEFPQKLFLQVLPQEFDVLCTHPMFGPESGKSSWVGLPFVYDKVRIGGGSRLERCDRFLNIFGSEGCRMVEMSCAEHDRYAAGSQFITHTVGRVLGKLALESTPINTKGYETLLGLVENTKGDSFELYYGLFMYNQNATEELERLELAFDSIKKQLFGRLHDVLRQQLFEGVGMKDRISLPNIVEDAAHKSTDFATAASNVVAHSKATPDRSSKRSGDNNGSS

SEQ ID NO: 129 - protein, 358 aa, A. thaliana
  misc_feature (1)..(358): A. thaliana 1g15710
MLLHFSPAKPLISPPNLRRNSPTFLISPPRSLRIRAIDAAQIFDYETQLKSEYRKSSALKIAVLGFGNFGQFLSKTLIRHGHDLITHSRSDYSDAANSIGARFFDNPHDLCEQHPDVVLLCTSILSTESVLRSFPFQRLRRSTLFVDVLSVKEFPKALFIKYLPKEFDILCTHPMFGPESGKHSWSGLPFVYDKVRIGDAASRQERCEKFLRIFENEGCKMVEMSCEKHDYYAAGSQFVTHTMGRVLEKYGVESSPINTKGYETLLDLVENTSSDSFELFYGLFMYNPNALEQLERLDMAFESVKKELFGRLHQQYRKQMFGGEVQSPKKTEQKLLNDGGVVPMNDISSSSSSSSSSS

SEQ ID NO: 130 - protein, 377 aa, S. lycopersicum
  misc_feature (1)..(377): S. lycopersicum07g007590
MLSFTPLQSKPTPTSNSNRFSNLTNPTSSTSRRRHFSVSSPSQVSHHHGRRRLSIKAIDAAQPYDYEALVSNQYAQSGRLKIAIVGFGNFGQFLAKSFVSKGHFVLAHSRTDYSQIAISLGVSFFQDPHDLCEQHPDVIVLCTSIISTETVLRSLPIQRLKRNTLFVDVLSVKEFPKNIFLQVLPTHFDILCTHPMFGPESGKDSWKDLIFMFDKVRIGEGRSRTARVDKFLDIFEKEGCRMVPMTCAEHDKHAAGSQFITHTMGRVLEKLGLESTPINTKGYETLLNLVDNTASDSFDLYYGLFMYNKNAMEELERLDLAFEALKKELFGHLHDLLRKQLFGKAEEAGQRRVLSKLPRNGYALPAPSSDAVKPENN

SEQ ID NO: 131 - protein, 390 aa, S. lycopersicum
  misc_feature (1)..(390): S. lycopersicum09g011870
MFSLSSIQSNNIQSQSSSSLLFNHHHQHSTISTRFHHHRLLFPLRAQNSDLTTATTNNNYVDLDDNLTRLDKFSKSLSISNIEENTSLNPLLCSNNKLKIAIIGFGNFGQFIAKSFIKQGHVVLAHSRSDYSLIAQSLNVHFFQDPNDLCEQHPDVILLCTSINSLENVIRSLPIQKLKRNTLFVDVLSVKEFPKNIFLQSLPKEFDILCTHPMFGPTSGKDNWKGLPFMYDKVRIGQEESRIKRVNNFINIFVKEGCRMVEMSCSEHDKYAAGSQFITHTIGRMLQRLGTQTTPINTKGYESLLNLMENTTSDSFDLYCGLFMYNNNSMEVLEKLDAALDSLKRELFGQVLQKLEKRVEKGSRLALPTPDFSKKIEKLKVERKELEALS

SEQ ID NO: 132 - protein, 270 aa, C. merolae
  misc_feature (1)..(270): C. merolae TyrA
MDQVNSSNSLTIAIVGFGNFGQFLAKAFVQAGHRVIGHSRTNYEAIARQLGCGFETSADALMDLHNPDIVVLSTSILSTEEVLRRFPTAKLRSCLVVDVLSVKVYARELMLRYAPEEADILATHPMFGPESGRGSWRGLPFVFERTRVRQHERCEAFLSIFRERGCTLIEMPCQEHDHYAASTQFITHTTGRMLAELKIASTPINTRGFEALLAVVETTVRDSFDLYYGLYRFNPNAKQELEKMQRALEQVRAQLEAYDRKCREAEARSA

SEQ ID NO: 133 - protein, 264 aa, G. sulphuraria
  misc_feature (1)..(264): G. sulphuraria TyrA
MNSSTRILKIGIVGFGNFGQFLAKTFVKQGHQVIGTSRSNYETEAKAIGALYVPEATDMMGEEPDVVLFCTSITSTRSVIEAFPIDALRGKLVVDVLSVKAYPKKLLLELLPPEADVLCTHPMFGPESGRYSWKGLPFVYEQVRISDGARCETFLGIFSSALCTMIPMSCELHDSYAASSQFITHTTGRMLAKLNLISTPINTKGYESLLGVVETTCKDSFDLYYGLYKYNPNAKLELEKLEQALQALRKELETREALDGWKKD

SEQ ID NO: 134 - protein, 241 aa, S. bacterium
  misc_feature (1)..(241): S. bacterium TyrA
MRIGIYGLGRFGAFFAGLLSSKAEVQAYSRNPDRPAPAGVRRVGEEELLAMPAVCLCVDIGAMPEVLARIAPRLGPGTLVLDTCSVKELPVRWMRELLPPGVEILASHPMFGPDSGARGVEGLPMILCPVRLQEARYREWEGFFSSFGLEVHRLAPEDHDRQAAYTQGLTHYLGRVLAELDLQPSAIGSLGYRRLLNIVEQTCNDTWRLFLDLQRYNPHTPAMRQALDRALEALKAKLDML

SEQ ID NO: 135 - protein, 263 aa, S. africana
  misc_feature (1)..(263): S. africana TyrA
MQIGVIGLGRFGMFWAQLLAQEAEAVYAWNRTPRALPAGVLPLGDADYQRLDIVFLCTSIASVGSVAETIASRLHPRTIVADTCSVKVEPLADLDRVIPAENPLLGTHPMFGPDSARNGADGLPMVFSPVRIAPDQLAMVQDFFRKYQLDQLVMTPEEHDREAAYTQGITHFIGRVLKDLDLKPSPIATLGYTRLLQVMEQTCNDPWSLFMDLQQRNPYTAAMRRDIRVSLDRTLQLLGDSDAGGDAAANAGPGADSGAASSD

SEQ ID NO: 136 - protein, 251 aa, S. smaragdinae
  misc_feature (1)..(251): S. smaragdinae TyrA SsTyrA
MVEHTVGIYGLGRFGSFWAKSLAASGLKVIGYNRSKRALPEGVVSGSETEVLSCNTLFYCVAISSFEEVLSRTAAKIGKHTLVFDTCSVKVEPVRTMERLLPQGCTFAGSHPMFGPDSASEGMDGLPMVLCPGRDDEGKVDFWRHHFSKMGLRVIEITADRHDKEAAYTQGITHVVGRILGELDLHESEIATSGYKRLLQVREQTCNDPLQLFIDLQRYNPYTHGMRMELTSALEQIMTLFAQADLPPDRP

SEQ ID NO: 137 - protein, 242 aa, H. marinus
  misc_feature (1)..(242): H. marinus TyrA
MKVGIIGFGRLGKLLTKNLSKDATTICYDINISKEEVESLGSKVGTLEEVCKSTILILCVPISAIESIADQIAPLVSKETLVVDVCSVKIHPMKILEEKLPQDTQILGTHPMFGPDSAAKSLYGCKIVLCQQRVSDERYRNIKGYLESHGLKVIEATADEHDQQIANTLILTHTIGRTLMEMNATEMEIDTKGYRRLLKILETVENDSVQLFKDMNKYNPHAKNMRTSLSSALEETLASVQS

SEQ ID NO: 138 - protein, 252 aa, D. bacterium
  misc_feature (1)..(252): D. bacterium TyrA
MSETSKGKKNIKIGIIGFGRFGKLTARYLSEDMDVFVHTRSNKTSEIREIGAYPASLEEACNQDIVIPTVPISTLEDILKKIAPLLKKDALVIDVCSVKEYPIKWMKELLPETVSILATHPMFGPDSAADSLKERKIVLCKVRIEEKFYNKIKSSLSSKGLTVIETTPEDHDRQIAVSLSLTHFIGRTLSEYGASELLIDTEGYKRLLHILGVVEHDTWQLFADMNRYNCYAEPERTAFMAAMKIVNERLKE

SEQ ID NO: 139 - protein, 345 aa, M. xanthus
  misc_feature (1)..(345): M. xanthus TyrA
MTESIALLGYGRFGRALSGLLLVAGIPHRVFEPRQDDVPDALRAPTLAESVEGAGLVVLSMPVSGMRSVLEELRPRLSPAQTVLDVGSVKVRPVQVLASVLGRDIPWVGTHPLFGPASLARGDLPRRTVVCPNELHPEAVRKARVLFERIGCEVTELSPDAHDALMVRTHVLTFFLAHGLLKAEAGKDLPFAPPSFQPVARLEEYARLEVPHLFGVVQSENPYARDARVRLLEALTQLHLGCDSGRSGAPEPVAAPPGLTEVRECVDALDRELVQLLNRRAQLIQQAAHLKAEHGLPLPDAEREASLLETRRQWAAEQGMDADDTEDVFRAVLRFSRRAVPTGSR

SEQ ID NO: 140 - protein, 246 aa, P. zucineum
  misc_feature (1)..(246): P. zucineum TyrA
MKTLGLIGLGQFGRLAAGILKDRFQVLASDPAPGAEDAARALGVGFGSLEAAAACDVVVVAVPVAAMREVFAAIAPHVKPGALVVDVGSVKVLPARWMAELLPAHADLVATHPLFGPQSVARDGLPGLRFVVCPIRGDRYERVAALGRELGLSVTITTPEEHDEEMAYVQALTHLIGRSLVNLGIPDERLATQSYQHLLELCGLIGADTFELFKAIQTQNPYAPKVVAAFVDEAKSLLEQVRAEGA

SEQ ID NO: 141 - protein, 261 aa, P. inhibens
  misc_feature (1)..(261): P. inhibens TyrA
MPQPPQFSRIGLIGFGAFGRLIARHLSPLLPICVYDPVQTDERPRHPSLRFDSLAETAACPLVILAVPVGAMEPLCHTLAPLVRPGTWVLDVGSVKMAPADVMQRVLPPEVNLLGTHPLFGPESTRQGLAGQKIALCPLRGGRPLRLAAVLRHIFRLEVIWTTPEAHDRELATVQGLTHLIAQALNQVAPETLRMTTASFELLQQASRMVTGDAHGVLEAILRDNPFAADIRDSFLERAADLGRHPVTPRTQQSPPNAAGF

SEQ ID NO: 142 - protein, 276 aa, B. canariense
  misc_feature (1)..(276): B. canariense TyrA
MSNDSNINSRPLIGIIGFGAFGRLTARHLLPHFRLYAYDPALRPGPCVEMLDVMLTDLRSAASCPIIILAVPVNRFEESVAAISPHLKPGSLVLDVGSVKMIPAEIMRRGLPEHVAIIATHPLFGPQSARDGINGLKIAICPIRGDRGRRVAAFLRKALGLNVVMTTPEAHDQDTAMAQGLTHLIAKVLVQMEPFPARMTTKSFDLLVQAIAMVRDDAPEVFQAIERSNPYSQRVRRRFFDLASALDAELGNRSPVRLSADRSSVKFDTSQTKQTD

SEQ ID NO: 143 - protein, 269 aa, O. intermedium
  misc_feature (1)..(269): O. intermedium TyrA OiTyrA
MRPLRGQSMSRDRNQHTKIGIIGFGAFGQLIARHLNPYFRLYAYDPAADLEQTALMHGVALASVEQVAACDIVILATPVATLESVVDKIAPHLCPGALVLDVGSVKVGPADIMRRGLPAHVDIVATHPLFGPQSARHGIAGLKIAVCPVRGTRFHRVAAFLKKHLSLNVIVTTPEDHDREAAMVQGLTHLIARVLVQMEPLPTRMTTKSFDLLMQAVSMVRHDAPEVFQAIEHANPYAPQVRRHFFALADQINEELARVQPMAAREEAA

SEQ ID NO: 144 - protein, 434 aa, P. decumbens
  misc_feature (1)..(434): P. decumbens TyrA
MGRTKEDASIGIIGMGDMGKMYAQRLSDAGWRVNACDRPENYESLKQEFASQQRVTIFPNGHFVSRISDFILYSVEAGVIDRVVAQYGPSTKVGAIVGGQTSCKGPELAAFEKHLPEDVEIVSCHSLHGPKVNPKGQPLVLIQHRASDESVQFVDRILSSFGSKHVYLSGEMHDRITADTQAVTHAAFLSMGTAWQANKQFPWEISRWVGGIENVKINITLRIYSNKWHVYAGLAILNPAAKQQIRQYAESVTELYKLMIGGHREELKRRVKAAGASVFKEGTASQDLLLKDEVLDQFSLSNRSREKAPPNSHLSLLAIVDCWSKLGIVPYDHMICSTPLFRLWLGVTEYLFRNPELLEEALDTAIDDNTFRSDDLEFTFAARAWSDCVSFGDFESYRDRFEKIASYFAPRFAEASKLGNEMMKTILEKTSNKP

SEQ ID NO: 145 - protein, 431 aa, S. pombe
  misc_feature (1)..(431): S. pombe TyrA
MKETFQVGIIGFGDMGRLYAEYISKAGWRVNVCDRPENYESIQATYGNGGYTVLKDGFQVSRTSDYILYSVEAEHIDKVVALYGPATKVGAIVGGQTSCKAPEMNAFEKYLPEDVDIISCHSMHGPKVNPKSQPLVIIRHRASDEHFEIVNEILSCFKSSVVYLSAKEHDRITADTQAVTHAAFLTMGLAWHANNQYPWEINRWCGGIENIKMNLSMRIYSSKWHVYAGLAILNPEAQRQIQQYASSVTELFKLAISGKAKEYEDRIRNAGKFVFGENMDRNSSGLLLSDELLDQYSISNIPKDESKRNSHLSILAIVDSWSKLGIHPQNHMICSTPLFRLWVGVSEYVFRHPGLLDSCIYTATKHNDFSPDDLEFVVAVRSWSECVAAKDFTTYKKRFLETQEYFRPRFEEATRVGNAMISKLLENLQKM

SEQ ID NO: 146 - protein, 505 aa, M. barkeri
  misc_feature (1)..(505): M. barkeri TyrA1
MSANLKPGSQVNTDQKPEKTKVLILGGTGEMGQWFTRFFKQKGYEVTVWGKGGKTEIASKLGVPFASDLEKAVPESDILIVSVPINVTEETIAEFAPKMKSGSLLMDFTSIKVKPVEAMKKFAPSDVEILGTHPMFGPTIPTIRGQTVILVPVKGRSEKWFPVIRELFEEGGAHVEITTAAEHDRLVSVVQGLTHFAYITIGTTIDRLDFDIKKSRKFVSPVYAIMLDFVGRILGQNPYLYALIQMENPGVLEVHDAFIRECEELSRLVRAHDEESFVKKMKSAARKYGDTAHALRKSDKLINSRITEYETILNSVGKVCGFSHFYSGKIHVGILGKAGPDEIVLTKMVSKGTSPHIKNKFVKLKLENLRMLSESELWEWRKENLEHSTRDISVLIPEGADPEVILNAINTNKQLAACEISDIYKGVNQGDHKRINRGDYKEFNRIETEKEREEAKRLGVTYRITVFGDCDANSVEADVTSLLCGLGCRIREKNLKQIEKTEPKR

SEQ ID NO: 147 - protein, 310 aa, M. harundinacea
  misc_feature (1)..(310): M. harundinacea TyrA MhTyrA
MTTMANSGTKNRMLIVGGTGGTGSWFAKYFKEHGFLVSIWGPSGKVEVAERLGVKFARDLMAEVAKSDVVLLSVPIKETAKVVEEVAPRMRPGSLLMDVTSLKAEPMKAMLRWAPDGVEVLGTHPMFGPTIPTIRGQTVILVPAAGRCDEWLLPMEEIFQEDGARVEVLGAEEHDRIMAVVQALTHFAYISIGSTLRSLDFDIAHSRRLMSPVYEIMIDFVGRILAQSPELYSSIQENPEAKRVREAYIEECQRLSKLADTGNSEGFMEAMRSAADHFDEREVALARSDRLISLWIDHREGKRRGLEPRW

SEQ ID NO: 148 - protein, 296 aa, M. concilii
  misc_feature (1)..(296): M. concilii TyrA
MVRILILGGTGETGSWFARYFKSKGWEVAIWGPSGKVEVAERLGVRYAHDMMAEVEESDVVLVSVLIEKTVEVIRQVAPRMHSGSLIMDVTSVKSGPVRAMKTYAPKGVEALGTHPMFGPTMPSLFGQTIIFTPVEGKTGKWLGVIRSLFESDGAKIEILEAEEHDETMAVVQALTHFAYISIGAALKALDFDVQRSHRFMSPVYEIMIDFVGRILDQNPELYASIQMNPKAAAARQAFVSECMRLCEKTDDGDMEGFKQMMREAALHYGGTHEALQRSDRVINSRIREKEEEGKR

SEQ ID NO: 149 - protein, 287 aa, D. mccartyi
  misc_feature (1)..(287): D. mccartyi TyrA
MKIGILGGSGKMGQWFGRFLSENGHQVWLWGRNPSKLTPVASRLGSQVITQPDQLTEMDCLVISVPIDAFEDTLKEIAPFTKREQLVFDLCSVKERPVEMMHQYLPHCRILGTHPVFGPGAKSLKGYNFILTPTTEAETALAEKVKTWLEKHESTVSLTSPEEHDRLMSVVLGLAHFIAIVSADTLLGQNLPGIAGAGGTTFRLLDTLTKSVLTEDPNLYASLQVNMPKLPKLEADFIKRATQWAELVKNGNKAGFAHRMQTLKDNLARTEPGFEKAYQDMYHLKQP

SEQ ID NO: 150 - protein, 289 aa, Dehalogenimonas sp.
  misc_feature (1)..(289): Dehalogenimonas sp. Strain WBC-2 TyrA
MKIVIIGGYGKMGAWFARLLKNEGHQVTIVGRDKDKLAAASVELGVSSSDNTGKAGEADVVVISVPVDSFEAVCHNLAPHLNSGQTVFDLTSVKVKPVDIMHRYFTGIKVLGSHPVFGPGAESLKGQNFILTPTDDIEKATAFKVSDWLSTRGARVRTTTPEEHDRLMSISLGLAHFIAIVTADALVSLDRLDEMNGAGGITYKALLTLVESVLSEDPALYASLQLNLPSLPETESLFSDKARDWATLVREGRRDEFVNRMSNLKAKLEASNPDFGASYQKLYHLANHR

SEQ ID NO: 151 - protein, 295 aa, D. alkenigignens
  misc_feature (1)..(295): D. alkenigignens TyrA
MVDIGPKNIAIVGGCGKMGAWFARLLKSEGHQVTLIGRDKHRLATTAAQLGVEAADRVDAVTAADIVIISVPIDSFDFVCSGLAPHVKPIQKVFDLTSVKTGPVTAMHRHFPHSLILGAHPVFGPGAKGLAGQNFILTPTSDAENELARKLSHWLTGRGARVRLTSPEEHDRLMAISLGLAHFIAIVTADALVSLDRLTEMSGASGITYKALLTLVESVLSEDPALYASLQLNLPHLPEIESLFADKAEYWASLVKDGRRDEFARRMAALKSKLETANPDFGVSYQALYRLTDRG

SEQ ID NO: 152 - protein, 620 aa, A. veneficus
  misc_feature (1)..(620): A. veneficus TyrA
MKPGILIYGMGRMGKFFYDFFFSRGYDVAGYDVVPERRTIEEDKIESYDVIFLCVPMQAVGDAIARIPRSSALIVDISSIKGFVLPYLDASGFDYLSIHPMFGPDSEIGLSNIIVVKKSGRKEEEVILEEFRKAGAVLSELPPEKHDAKMAEIQGLAHFLLVGMAHFLAERFDREDLKYASPIFATLYKLSSRILNQDWRMYYYIQKNAEILRREFIKSLADLDAKFSDEEKFRKLFEELGSKFDDYGNSTLILDACKATWDVSTIELLRGYIRAVDSLILRLLERRTQAGRKIALHKRDRNEPIEIADLEEVKIKDLLLRTSLNPIYVQDIFENIMGLTKEEEYRVLGIKKTLAVLGPAGSFSEEAALKLVGSRLPLKYCATTDEIIKCVENGSADYGLVPIENSVNGTVISVLDALLNHDVEVFGETTLEIVHCLAARRYMPLKEIRVVYSHPQAIAQCMGFINNYLKAELRYTSSTSDAIALLDDYSAAIVSENAAKLHKLYVLRKGIQDAKANTTRFYLIRKKGSGEMRGSITSLFFGVEDRPGALKDVLEVFYRKGINMRKLESRPARTGLGDYVFFVEVEKDLSSEDLRELRNVTTFYHIVGVFDRVERLDLWG

SEQ ID NO: 153 - protein, 622 aa, G. ahangari
  misc_feature (1)..(622): G. ahangari TyrA
MRILIYGMGGMGGIFHRFFENRGYFVKGYDLNPDRSEVSYGEIDGFDVIFLCVPMDEIENALEDIARKNRSALIVDISTLKNLAIPHLERLGFDYLSIHPMFGPDSEIGLSNIIVVHESGREEERVILEEFRRAGAIISHISVEEHDRKMAEIQGTAHFLLFLFALTLRGRFGKAYHYGSPIFLVMHKLASRIINQDWRLYYHIQKNAEELRKEILENARVLDEIMKDERSFKGLVDELREEFDDYRDSTIVLDAYKTTVNAEGIDMLRGYIRAIDSLVLRLIEKRVEAGRKVAMEKLKLNEPVEISHVEDVKLRELVTKTELNPVMVSEIFERLMKLTKEEEYRILGVRKKVAVLGPPGSFSEETALKLVGSRLPLIYQSKVEDIFLAVESGKADYGIVPIENSLQGTVLQTLDALLRHDVEVFAEYESEIRHNLVAKKRLPLRDIEVVYSHPQAIAQCSEFINNYLPHAEIRYTRTTSEAIEMLDDRSAAIASELAAKLYRLQVIKRDIQSLTSNRTRFYIIRRSGGSVNGDESLTCLFFGVDDRPGALYRVLEVFYKNGINLRKLESRPAGTRLGDYIFFAEAEEKLGENIVEEIKKRTTFCKVAGFFRKVDRLDVFTG

SEQ ID NO: 154 - protein, 377 aa, Haemophilus influenzae
  misc_feature (1)..(377): 2PV7
MSFMEALKDLRSEIDSLDRELIQLFAKRLELVSQVGKVKHKHGLPIYAPEREIAMLKARRLEAEKAGISADLIEDVLRRFMRESYANENQFGFKTINPDIHKIVIVGGYGKLGGLFARYLRASGYPISILDREDWGVAESILTNADVVIVSVPINITLETIERLKPYLTENMLLADLTSVKREPLEKMLEIHSGAVLGLHPMFGSDIASMAKQVVVRCDGRFPERYEWLLEQIQIWGAKIYQTDATEHDHNMTYIQALRHFSTFANGLHLSKQPINLANLLALSSPIYRLELAMIGRLFAQDAELYADIIMDKPENLAVIETLKQTYEEALAFFENNDRQGFIDAFHKVRDWFGDYSEQFLKESRQLLQQANDLKQG

SEQ ID NO: 155 - protein, 377 aa, H. influenzae; identical to SEQ ID NO: 154
  misc_feature (1)..(377): H.influenzae TyrA HiPDH

SEQ ID NO: 156 - protein, 373 aa, N. archeti
  misc_feature (1)..(373): N.archeti TyrA
MVAELTALRDQIDEVDKALLDLLATRLKLVAEVGEVKSRYGLPIYVPEREASMLASRRKEAQALGVPPDLIEDVLRRVMRESYSSENDKGFKTLCPQLRPIVIIGGKGKMGQLFNRMLTLSGYQVRVLEQEDWPQAETLLADAGMVIVSVPIHLTEQVIARLPPLPADCILVDLASVKNRPLQAMLAVHEGPVVGLHPMFGPDVGSLAKQVVVYCDGREPEAYQWLLEQLQVWGARLHRISAVEHDQNMAFIQALRHFATFAYGLHLAEENVQLEQLLALSSPIYRLELAMVGRLFAQDPQLYADIIMSSENNLALIKRYYQRFGEAIALLEQGDKQAFIDSFKKVEHWFGDYAQRFLVESRTLLLQANDNRQ

SEQ ID NO: 157 - protein, 373 aa, C. freundii
  misc_feature (1)..(373): C.freundii TyrA
MVAELTALRDQIDEVDKVLLDLLARRLELVAEVGEVKSRFGLPIYVPEREASMLASRRAEAEALGVPPDLIEDVLRRVMRESYSSENDKGFKTLCPSLRPVVIVGGGGQMGRLFEKMLTLSGYQVRILEQQDWDRAPEIVSDAGMVIVSVPIHITEQVIAKLPRLPSDCILVDLASVKNGPLQAMLAAHDGPVVGLHPMFGPDSGSLAKQVVVWCDGRQPEAYQWFLEQIQVWGARLHRISAVEHDQNMAFIQALRHFATFAYGLHLAEENVQLEQLLALSSPIYRLELAMVGRLFAQDPQLYADIIMSSENNLALIKRYYQRFGEAIGLLEQGDKQAFIDSFRKVEHWFGDYAKRFQSESRTLLRQANDSRP

SEQ ID NO: 158 - protein, 373 aa, E. coli
  misc_feature (1)..(373): E. coli TyrA EcPDH
MVAELTALRDQIDEVDKALLNLLAKRLELVAEVGEVKSRFGLPIYVPEREASMLASRRAEAEALGVPPDLIEDVLRRVMRESYSSENDKGFKTLCPSLRPVVIVGGGGQMGRLFEKMLTLSGYQVRILEQHDWDRAADIVSDAGMVIVSVPIHVTEQVIGKLPPLPKDCILVDLASVKNGPLQAMLAAHDGPVLGLHPMFGPDSGSLAKQVVVWCDGRKPEAYQWFLEQIQVWGARLHRISAVEHDQNMAFIQALRHFATFAYGLHLAEENVQLEQLLALSSPIYRLELAMVGRLFAQDPQLYADIIMSSERNLALIKRYYKRFGEAIELLEQGDKQAFIDSFRKVEHWFGDYAQRFQSESRVLLRQANDNRQ

SEQ ID NO: 159 - protein, 279 aa, Synechocystissp.
  misc_feature (1)..(279): 2F1K
MKIGVVGLGLIGASLAGDLRRRGHYLIGVSRQQSTCEKAVERQLVDEAGQDLSLLQTAKIIFLCTPIQLILPTLEKLIPHLSPTAIVTDVASVKTAIAEPASQLWSGFIGGHPMAGTAAQGIDGAEENLFVNAPYVLTPTEYTDPEQLACLRSVLEPLGVKIYLCTPADHDQAVAWISHLPVMVSAALIQACAGEKDGDILKLAQNLASSGFRDTSRVGGGNPELGTMMATYNQRALLKSLQDYRQHLDQLITLISNQQWPELHRLLQQTNGDRDKYVE

SEQ ID NO: 160 - protein, 279 aa, Synechocystis sp. PCC6803; identical to SEQ ID NO: 159
  misc_feature (1)..(279): S.spPCC6803 TyrA SyADH

SEQ ID NO: 161 - protein, 314 aa, B. dentium
  misc_feature (1)..(314): B.dentium TyrA
MVKQRIAIVGLGLIGGSLARRLVNAGCEVTAWNHNDRPYATAETDGITCMPTLAALADGRPDVLVLCNPLKAMPQILSALKPLIDQNVTTLTDVGSVKGMVRDQVKAVGLENCYVGAHPMAGNELSGWESSDPALYDDALWAITVDERTEYRRFLAVATMITDACANRLIVLDDATHDRCAALISHMPHVIATAMVNELVVNPNRNVAAALAAGSWRDMTRVALTDPDRTRAMVEEDAANVELLLRNMANRLTLMANVLHGVQPQGAGALQTAATQESDAKEMARFFEQGQPFRDYKTAIRQPDFMERCETVSL

SEQ ID NO: 162 - protein, 346 aa, B. adolescentis
  misc_feature (1)..(346): B.adolescentis TyrA
MVKPRIAIVGLGLIGGSLARRLVNAGCEVTAWNHNDRPYATAEADGIICKPTLAALAETKPNVLVLCNPLKAMPEILGALKPLIDTETTTLTDVGSVKGMVRDQVKAIGLDGCYVGAHPMAGNELSGWEASDPTLYDDALWAITVDEHTEYRRFRAVADMIVNRCGNRLIVLDDATHDRCAALISHMPHVIATAMINELVANPNRNIAAALAAGSWRDMTRVALTDPNRTRAMVEEDAANVETLLRNMANRLTLVANVLHDMADTGVRPTEGDVKQMDRFFAQGQPFRDYKAASRQPEYAEHCATVELSIPENDWQRTLLESARRGEHIVRFDGERTAIAQARSVV

SEQ ID NO: 163 - protein, 293 aa, Z. mobilis
  misc_feature (1)..(293): Z. mobilis TyrA
MTVFKHIAIIGLGLIGSSAARATKAYCPDVTVSLYDKSEFVRDRARALNLGDNVTDDIQDAVRAADLVLLCVPVRAMGIVAAEMAPALKKDVIICDTGSVKVSVIKTLQDNLPNHIIVPSHPLAGTENNGPDAGFAELFQDHPVILTPDAHTPAQAIAYIADYWEEIGGRINLMSAEHHDHVLALTSHLPHVIAYQLIGMVSGYEKKSRTPIMRYSAGSFRDATRVAASEPRLWQDIMLENAPALLPVLDHFIADLKKLRTAIASQDGDYLLEHFKESQKARLALKTDHDIHP

SEQ ID NO: 164 - protein, 368 aa, S. thermophiles
  misc_feature (1)..(368): S. thermophiles TyrA
MSKKTIYIAGLGLIGGSLALGIKRDHPDYEILGYNRSDYSRNIALERGIVDRATGDFKEFAPLADVIILAVPIKQTMAYLKELADLDLKDNVIITDAGSTKREIVEAAERYLTGKNVQFVGSHPMAGSHKSGAIAADVTLFENAYYIFTPTSLTKETTIPELKDILSGLKSRYVEIDAAEHDRVTSQISHFPHLLASGLMEQAADYAQAHEMTNHFAAGGFRDMTRIAESEPGMWASILMTNGPAVLDRIEDFKKRLDHVADLIKAEDESAIWEFFDNGRKKRKEMEIHKKGGVESAFDIFVDVPDREDVILSIMELLRGTSLVNIRINEENREDIHGILQITFKNEKDRKHARTVIEANTDYHVVIA

SEQ ID NO: 165 - protein, 587 aa, P. aeruginosa
  misc_feature (1)..(587): P. aeruginosa TyrA PaPDH
MTEVTPLQQSTPKLGRLVVVGLGLIGGSFAKGLRSKGLFREVVGVDRDAESCRLAVELGVVDRCEEDLGRACVGADVIQLAVPILAMERVLADLAKLDLGKAVLTDVGSAKGNIVRAARVAFGGMPRYLVPGHPIAGSEQSGVTAAKATLFRRHKVILTPSAETDADALALVDSLWRALGADVEHMEVEHHDEVLAATSHLPHLLAFTLVDSLAKRSENLEIFRYAAGGFRDFTRIAGSDPVMWHDIFLANREAVLRTLDVFRDDLDALREAVDTGDGHQLLGVFTRARVAREHFSKILARRAYVDAMHNNDLIYLAQPGGSLSGTIRVPGDKSISHRSIMLGSLAEGTTEVEGFLEGEDALATIQAFRDMGVVIEGPQNGRVTVHGVGLHGLKAPPGPIYLGNSGTSMRLLSGLLAAQPFDSTLTGDASLSKRPMNRVAKPLREMGAVIETGPEGRPPMTIRGGQRLTGMHYDMPMASAQVKSCLLLAGLYAAGETSVTEPAPTRDHTERMLRGFGYPVVVEGSTAKVESGHKLSATHIEVPADISSAAFFLVAASIAEGSELVLQHVGINPTRVGVIEILRLMGG

SEQ ID NO: 166 - protein, 281 aa, A. aeolicus
  misc_feature (1)..(281): A.aeolicus AaPDH
MQNVLIVGVGFMGGSFAKSLRRSGFKGKIYGYDINPESISKAVDLGIIDEGTTSIAKVEDFSPDFVMLSSPVRTFREIAKKLSYILSEDATVTDQGSVKGKLVYDLENILGKRFVGGHPIAGTEKSGVEYSLDNLYEGKKVILTPTKKTDKKRLKLVKRVWEDVGGVVEYMSPELHDYVFGVVSHLPHAVAFALVDTLIHMSTPEVDLFKYPGGGFKDFTRIAKSDPIMWRDIFLENKENVMKAIEGFEKSLNHLKELIVREAEEELVEYLKEVKIKRMEI

SEQ ID NO: 167 - DNA, 34 bp, Artificial Sequence
  Synthetic: forward primer
cattctggccgaaagcccggaactgtatagtagc

SEQ ID NO: 168 - DNA, 37 bp, Artificial Sequence
  Synthetic: reverse primer
gttccgggctttcggccagaatgcggcccacaaaatc

SEQ ID NO: 169 - protein, 268 aa, Unknown; identical to SEQ ID NO: 123
  MtPDH WT

SEQ ID NO: 170 - protein, 271 aa, Unknown; identical to SEQ ID NO: 121
  GmPDH1 WT

SEQ ID NO: 171 - protein, 274 aa, Glycine max
  misc_feature (1)..(274): Gmax11g35760 WT
MTTMSTSSSSQSLKIGIVGFGNFGQFLAKTMIKQGHTLTATSRSDYSQLCLQMGIHFFRDVSAFLAADIDVIVLCTSILSLSEVVGSMPLTSLKRPTLFVDVLSVKEHPRELLLRELPEDSDILCTHPMFGPQTANNGWTDHTFMYDKVRIRDEATCSSFIQIFATEGCKMVQMSCEEHDRAAAKSQFITHTIGRTLGEMDIQSTPIDTKGFETLVKLKETMMRNSFDLYSGLFVYNRFARQELENLEHAFYKVKETLMIQRSNGEQGHKRTES

SEQ ID NO: 172 - protein, 274 aa, Bituminaria bituminosa
  misc_feature (1)..(274): Bbituminosa68922 WT
FSTMSTSSSFQNLKIGIVGFGNFGQFLAKTMIKQGHTITATSRSDYSQLSLQMGIHFFRDISEFLAVDIDVIVLCTSILSLSEVVGSMPLTSLKRPTLFVDVLSVKEHPREVLLRVLPEDSDILCTHPMFGPQTAKNGWKDHTFMFDKVRIRDEATCSNFIQIFASEGCKMVQMSCEEHDRAAAKSQFITHTIGRTLGEMDIQSTPIDTTGFETLVKLKETMMKNSFDLYSGLFVYNRFARQELENLEHALRKVKETLMIQSIDEEQDKKITES

SEQ ID NO: 173 - protein, 269 aa, Proteus vulgaris
  misc_feature (1)..(269): Pvulgaris01g247200 WT
MSSSSSSSQSLKIGIVGFGTFGQFLAKTMIKQGHSLTATSRSDYSDLCLQMGIHFYGDVTAFLASDIDVIVLCTSILSLSEVVGSMPLASLKRPTLFVDVLSVKEHPRELLLRELPEHSDILCTHPMFGPVSGKNGWKGLTFMYDKVRIRNEAICSSFIQIFASEGCKMVQMTCEEHDKAAAKSQFITHTIGRTLAEMDIKSTPIDTKGFEELVKLKETMIGNSFDLFSGLFVYNRFARQELENLEHALQKVKETLVERKNEEQGQEKN

SEQ ID NO: 174 - protein, 265 aa, Glycyrrhiza glabra
  misc_feature (1)..(265): Gglabra9954 WT
NSNSQSLKIGIVGFGTFGQFLAKTMIKQGHTLTATSRTDYSQLCIQLGIHFFRDVSAFLDADMDVILLCTSIPSLSEVVGSMPLTRLKRPTLFVDVLSVKEHPRNLLLRVLPEESDILCTHPMFGPVSGKNGWKDLIFMYDKVRVRDEVTCSKLLQIFASEGCKMVEMSCEEHDKAAAKSQFITHTIGRSLAEMDIKSTPIDTKGFQALVQMKETVMGCSSDLYSGLFLHNRFARQELENLEHALYKVKEMLVQKMNEEQSPERT

SEQ ID NO: 175 - protein, 266 aa, Astragalus membranaceus
  misc_feature (1)..(266): Amembranaceus5597 WT
ASSQSLKIGIVGFGTFGQFLAKTMMKQGHTLTTTSRSDYSEICNQMGIHFFRDVTTLLDADMDVLLLCTSISSLSEVVGSMPLTRLKRPTLFVDVLSVKEHPRNLLLQVLPEESDILCTHPMFGPVSGKNGWKELTFMFDKVRIRDQVTCSKFLQIFETEGCKMVEMSCEEHDKAAAKSQFITHTIGRTLAEMDIKSTPIDTKGFQALNQLKDTVMGCSFDLYSGLFVYNRFARQELENLEHALHKVKEMLVPRINEEHGPERTES

SEQ ID NO: 176 - protein, 269 aa, Unknown
  Peanut PDH/ADH WT
MSSSHSQNMKIGIVGFGTFGQFLAKTIIKQGHTITATSRSDYSHLCLQMGIHFFRDMSAFLDAGNDVILLCTSILSLAEVMRSMPLTCLKRPTLFVDVLSVKEHPRNLLLRTLPGELDILCTHPMFGPISGKDGWKDLTFMYDKVRIQDEAKCSRFLQIFETEGCRMVEMSCEEHDKAAARSQFITHTIGRTLGEMDIRSTPIDTKGFETLVQLKETTMKCSFDLYSGLFTHNRFAIQELENLEHALFKVKEMLVQMMKEEQGQEKTES

SEQ ID NO: 177 - protein, 281 aa, Arachis duranensis
  misc_feature (1)..(281): AduranensisL1RYW WT
MSSSHSQNMKIGIVGFGTFGQFLAKTIIKQGHTITATSRSDYSHLCLQMGIHFFSDMSAFLDAENDVILLCTSILSLAEVMRSMPLTCLKRPTLFVDVLSVKEHPRNLLLRTLPGELDILCTHPMFGPISGKDGWKDLTFMYDKVRIQDEAKCSRFLQIFETEIKVKKSNDDDPNLVMNSSKVNYYFRMYIVCITQGCRMVEMSCEEHDKAAARSQFITHTIGRYMKETTMKCSFDLYSGLFTHNRFAIQELENLEHALFKVKEMLVQRMKEEQGQEKTES

SEQ ID NO: 178 - protein, 266 aa, Unknown; identical to SEQ ID NO: 124
  MtncADH WT

SEQ ID NO: 179 - protein, 358 aa, Unknown; identical to SEQ ID NO: 129
  AtADH2 WT

SEQ ID NO: 180 - protein, 270 aa, Arachis duranensis
  misc_feature (1)..(270): AduranensisP7PS3 WT
MSSSSSSSSLKIGIIGFGTFGQFLAKTMIKQGHTLTATSRTDYSQHSLQLGIQFFRDVNEFLEADNDVILLCTSIISLSGVLDSMPISSLKRSSTLFVDVLSVKEHPRELLLRKLPEESDILCTHPMFGPESGKNGWKDLTFMYDKVRIRDEVICSNFLNIFATEGCRMLQMTCEEHDKLAAKSQFITHTIGRTLAEMDAKFTPIDTKGFQTLVQLKDSTMRDSFDLYSGLFLHNRFARQELENLEHALHKVKEMLVQRMSDVLGTEKTA

SEQ ID NO: 181 - protein, 270 aa, Arachis ipaensis
  misc_feature (1)..(270): AipaensisP6A5Q WT
MSSSSSSSALKIGIVGFGTFGQFLAKTMIKQGHTLTATSRTDYSQHSLQPGIQFFRDVNEFLEADNDVILICTSIISLSGVLDSMPISSLKRSSTLFVDVLSVKEHPRELLLRKLPEESDILCTHPMFGPESGKNGWKDLTFMYDKVRIRDEVICSNFLNIFATEGCRMLQMTCEEHDKLAAKSQFITHTIGRTLAEMDAKFTPIDTKGFQTLVQLKDSTMRDSFDLYSGLFLHNRFARQELENLEHALHKVKEMLVQRMSDVLGTEKTA

SEQ ID NO: 182 - protein, 257 aa, Glycyrrhizaglabra
  misc_feature (1)..(257): Gglabra8888 WT
SSSTLKIGIVGFGSFGQFLAKTMIKQGHTLRATSRTDYSHLCLQMGIRFFRGVIAFVEADNDVILICTSILSLSEVLRSMPLSRLKRPTLFVDVLSVKEHPRDLLLRVLPEDSDILCTHPMFGPESGKDGWKDLTFVYDKVRIRDEAICSNFLHIFASEGCRMLQMSCEEHDKVAAKSQFITHTIGRTLEEMNIESTPIDTKGFQTLVQLKDTTMRDSFDLYSGLFIHNRFAKQELENLEHALHNVKEMLVQKMNED

SEQ ID NO: 183 - protein, 264 aa, Bituminaria bituminosa
  misc_feature (1)..(264): Bbituminosa16676 WT
TWSLKIGIVGFGSFGQFLAKTMIKQGHTLRATSRTDYSHLCLQMGIQFFRDVAAFLEADNDVILICTSILSLSEVLSSMPLTRLNRPILFVDVLSVKEHPRNLLLRVLPEESDILCTHPMFGPDSGKYGWKDLTFVYDKVRIRDEAICSNFLQIFASEGCRMLQMSCEEHDKIAAKSQFITHTIGRTLAEMDIKSTPIDTTGFRTLVQLKDTTIRDSFDLYNGLFLRNRFAVQELENLENALHKVKEILVQRKSEELGLEKTEC

SEQ ID NO: 184 - protein, 266 aa, Unknown
  GmncADH WT
MSTWSLKIGVVGFGSFGQFLAKTMIKQGHTLRATSRTDYSLLCLPMGIQFFRDVAAFLEADNDVILVCTSILSLSEVLSSMPLTCLKRSTLFVDVLSVKEHPRNLLIKVLPEESDILCTHPMFGPDSGKDGWQDLTFVYDKVRIRDEAICSSFLHIFASEGCRMLQMSCEEHDKIAAKSQFITHTIGRTLAEMDIKSTPIDTKGFHSLVQLKDTTIRDSFDLYSGLFLHNRFAVQELENLEHALHKVKEMLVQRKSEELGLEKTEC

SEQ ID NO: 185 - protein, 272 aa, Solanum lycopersicum; identical to SEQ ID NO: 126
  misc_feature (1)..(272): SolyncADH WT

SEQ ID NO: 186 - protein, 270 aa, Gossypiumraimondii
  misc_feature (1)..(270): Graimondii06g129300.1 WT
MSSSSSLPLQTLKIGIVGFGTFGQFLAKTMIKQGHTTRATSRTDYSQLCHQLDVPFFRDVIPFLEADNDVILICTSILSLSEVLNSMPLRRLKRHTLFVDVLSVKEHPRNVLLQVLPENMDVLCTHPMFGPESGKNGWKDLPLVYEKVRVRNETRCSSFLHIFESEGCRMVEMSCEEHDKVAARSQFLSHSIGRILAEMGIESTSMNTKSFETLVKLKESATNDSFDLFSGLFIHNRFAQQELMNLEQSFEKVKQRLLKKMSEQQSLSSV

SEQ ID NO: 187 - protein, 278 aa, Theobroma cacao
  misc_feature (1)..(278): Tcacao1EG010641t1 WT
MSSSSDSFSSLTLNIGIVGFGTFGQFLAKTMIQQGHTISATSRTDYSQLCHQLGISFFRDVAAFVEADNDVILISTSILSLSKMLKSIPFRCLKRRTLFVDVLSVKEHPRDVLLQVLPEEMDLLCTHPMFGPESGKSGWEDLVLMYDKVRVRDEATCSSFLRIFERQGCRMMQMSCEEHDRLAARSQFLTHAIGRILSETGIESTSINTKSFETLVKLKESTTNDSFDLFSGLFIHNRFAKQELMNLEHAFQMVKKKLLQTANEEQIPNKSNHQMDSC

SEQ ID NO: 188 - protein, 371 aa, Gossypiumraimondii
  misc_feature (1)..(371): Graimondii09g126800.1 WT
MLIFSPTTIRSVNPQPLPYLSFSHSISLPLPLTSLPTPSKSPHFPSFHINCIDAAQPFDYESHLKNRYIQSTSLKIAIIGFGNFGQFLSKTFLRHHTLLAHSRTNYADLANHLGVSFYADPHDLFEQHPDVVLLSTSILSTETLLQKLPFQRLRRNTLFVDVLSVKEFPRNLFLKYLPPDFDILCTHPMFGPESGKTSWAGLPFVYDKVRIGDEESRIKRCDKFLDIFEKEGCRMVEMSCMEHDKYAAGSQFVTHTMGRVLEKFGLESSPINTKGYETLLNLVENTKGDSFDLYYGLFMYNQNALEQLERLDMAFESIKKDLFGRLHQVYRKQLFGDNNGEVEKKRSLAQQLLGNGSLTESPLDNVRQDGS

SEQ ID NO: 189 - protein, 468 aa, Theobroma cacao
  misc_feature (1)..(468): Tcacao1EG027290t1 WT
MIKKNEDATFLPSVHLHLTKLLLVGGLEPNLTNLQKKKVKVVEPQPTTSDSKLGPQREGKIKSPLKYSIPQLGEANGNTIFESVHCLPQFCVKFRILRMLLFSATRPLNPPQPLPFLSFSRFVSLSLPLPILPNPSRSTHFPSLQIYSIDAAQPFDYESHLKNRYLQSTSLKIAIIGFGNFGQFLSETFIRHHHTLLAHSRTNYTNLANQLGVSFFSDPNDLFEQHPDVVLLSTSILSTETLLQQLPFQRLRRNTLFVDVLSVKEFPRNLFLKYLPPDFDILCTHPMFGPESGKNTWAGLPFVYDKVRIGDEESRVKRCEKFLDIFEKEGCRMVEMSCMEHDKYAAGSQFVTHTMGRVLEQFGLESSPINTKGYETLLNLVENTKGDSFDLYYGLFMYNQNALEQLERLDMAFESIKKELFGRLHRVYRKQLFGDKEEKERERRFAQKLLGNGGLIDPPLDNVGQDGS

SEQ ID NO: 190 - protein, 377 aa, Solanum lycopersicum; identical to SEQ ID NO: 130
  misc_feature (1)..(377): Slycopersicum07g007590 WT

SEQ ID NO: 191 - protein, 391 aa, Solanum lycopersicum
  misc_feature (1)..(391): Slycopersicum09g011870 WT
MFSLSSIQSNNIQSQSSSSLLFNHHHQHSTISTRFHHHRLLFPLRAQNSDLTTATTNNNYVDLDDNLTRLDKFSKSLSISNIEENTSLNPLLCSNNKLKIAIIGFGNFGQFIAKSFIKQGHVVLAHSRSDYSLIAQSLNVHFFQDPNDLCEQHPDVILLCTSINSLENVIRSLPIQKLKRNTLFVDVLSVKEFPKNIFLQASLPKEFDILCTHPMFGPTSGKDNWKGLPFMYDKVRIGQEESRIKRVNNFINIFVKEGCRMVEMSCSEHDKYAAGSQFITHTIGRMLQRLGTQTTPINTKGYESLLNLMENTTSDSFDLYCGLFMYNNNSMEVLEKLDAALDSLKRELFGQVLQKLEKRVEKGSRLALPTPDFSKKIEKLKVERKELEALS

SEQ ID NO: 192 - protein, 654 aa, Fragaria vesca
  misc_feature (1)..(654): Fvesca17779 WT
MSLRGLLMASTFEKTTHINPSITSSSDEAGYTCKCNQHSSSMVITVVAVTQNSEFLTEFHNVQMLKIAIIGFGNLGQSLAKTFAHLGHIVLAHSRCEHSKMAQDLGISYFSNPQELCEQNPQVILLCTSIISTESVLKSLPLQSLTHDTLFVDMLPVKEFSKALLLKMLPSNLAVVCTNPMFGVERGKHEWNGSFLVYEKVRIGSDSVGISLCDNFLNIFEKEGCRMVEVSCSVQDKYVAGSQFITHTVGRVLEKLTLESTPINTKGYETLLDLVDNTAGDSFDLYCELFIYNKNAFEMFDRLDLAFNTLKKQLFGHLHDIVRKQLFDSAEKVHAEYMVCNPSHNGAALRSHSQVLNQKAHISEHYDDKSMLKIAIVGFGNFGQFLAKTIIRQGHKVLAYSRSDYYDVAQEMGVIYLSDVEALCEEHPEVMLFCTSILSTEKVLRSFPVQRLMRNTLFVDVLSVKEFPRNLFLQKLPLDFDILCTHPMFGPESGKNGWNALPFVYDKVRVGSDKSRVSLCDRFLDIFALEGCRMVEMSCSEHDRHAAGSQFITHTIGRVLEKLGLESTPILPNGYKALLNLVENTVGDSFDLYHGLFMYNVNAIDQLNRLDMAFNSLKEQFLRRLHGVVHSQHFENASRTLLPNHPENAAPLRR

SEQ ID NO: 193 - protein, 640 aa, Arabidopsis thaliana
  misc_feature (1)..(640): Athaliana5g34930.1 WT
MAETLITKPPLSLSFTSLSSMLPSLSLSTANRHLSVTDTIPLPNSNSNATPPLRIAIIGFGNYGQFLAETLISQGHILFAHSRSDHSSAARRLGVSYFTDLHDLCERHPDVVLLCTSILSIENILKTLPFQRLRRNTLFVDVLSVKEFAKTLLLQYLPEDFDILCTHPMFGPQSVSSNHGWRGLRFVYDKVRIGEERLRVSRCESFLEIFVREGCEMVEMSVTDHDKFAAESQFITHTLGRLLGMLKLISTPINTKGYEALLDLAENICGDSFDLYYGLFVYNNNSLEVLERIDLAFEALRKELFSRLHGVVRKQSFEGEAKKVHVFPNCGENDASLDMMRSEDVVVKYEYNSQVSGSVNDGSRLKIGIVGFGNFGQFLGKTMVKQGHTVLAYSRSDYTDEAAKLGVSYFSDLDDLFEEHPEVIILCTSILSTEKVLESLPFQRLKRSTLFVDVLSVKEFPRNLFLQTLPQDFDILCTHPMFGPESGKNGWNNLAFVFDKVRIGMDDRRKSRCNSFLDIFAREGCRMVEMSCAEHDWHAAGSQFITHTVGRLLEKLSLESTPIDTKGYETLLKLVENTAGDSFDLYYGLFLYNPNAMEQLERFHVAFESLKTQLFGRLHSQHSHELAKSSSPKTTKLLTS

SEQ ID NO: 194 - protein, 680 aa, Fragaria vesca
  misc_feature (1)..(680): Fvesca30772 WT
MPPLSLHPFPPKLIPTPSLLFNPQSPNLYPQSSHLYYHTPNSTPKRRRFGLQIKSLDAAQVFDYESKLAAQFRSSQTLTIAIIGFGNFGQFLAKTLTRQGHTVLAHSRSDHSAAAAKLGVSFFPDPHDLCEQHPHVILLCTSIISAAAVLSSLPVQRLRRSTLFADVLSVKEFSKALFLNALPPYFDLICTHPMFGPESAKESWNELHFVFEKVRIGEEGSRAERCEKFLSIFEREGCKMVEMSCVEHDKYAAGSQFITHTVGRVLGMLRLESTPINTKGYETLLDLVENTAGDSFDLYYGLFVYNKNALDMLERLDSAFEALKAQLFGRLHDVVRNQLFGNAGKVRPLQEENVNQNGAALVRSSIAGRPLKVHVLDSSGDDNSMLRVGIVGFGNFGQFLAKTIVRQGHKVLAYSRSDYSDVARLLGVSYFSDADDFCEEHPEVIILCTSILSTEKVLMSLPLQRLKRSTLFVDVLSVKEFPRSLFLQRLPPYFDILCTHPMFGPESGKNGWNGLAFVYDRVRIGNEESRVSRCDQFLDIFAQEGCRMVQMSCEEHDKHAAGSQFITHTMGRILEKLGLESTPVNTKGYKTLLNLVENTAGDSFDLYYGLFMYNANAMEQLKRLDNAFEALKKQLFGRLHGVSRKQIFENEDDSQHLLPTPSENESASTSSLEALNIQNN

SEQ ID NO: 195 - protein, 682 aa, Gossypiumraimondii
  misc_feature (1)..(682): Graimondii10g059700.1 WT
MITHPCLHPSLSKPSLSFLSSSSPPFLQHLSFLPTSPSVTKPVFVHSVKPLHVKCSSTNPTSQSHPDHAPPISTLKIAIIGFGNYGQFLAKTLVSQGHIVLAHSRSDYSHVAKKLGVSFFLNPHDLCEQHPEVILLCTSIISTEQVLKTLPLQRLKRSTLFVDVLSVKEFARNLLLDALPLDFDIICSHPMFGPQSAKQSWKDLFFVYEKVRIGNESSRVQRCEQFLEIFQSEGCKMVEMSCQEHDKLAAGSQFMTHTVGRVLDMLGLESTPINTKGYETLLDLVENTCRDSFDLYYGLFLYNKSALEMVERLDLAFDALRNELFGRLHHVVRKQFFENGEKVKSVHDSSYQNGAASAFSSNALRSQDVTIPYEFKGKILESVDDSSKLKVAIVGFGNFGQFLAKTLARQGHSVLAYSRTDYRDAAQKLGVSFFSDANDLCEEHPEVILLCTSILSTEKVLKSLPFQRLKRSTLFVDVLSVKEFPRNLFLQHLPPEFDILCTHPMFGPESGKNGWNELPFVFDKVRIGNDERRVARCNSFLDIFAREGCRMVEMTCAEHDWHAAGSQFITHTMGRVLEKLQLESTPINTKGYETLLNLVENTAGDSFDLYYGLFMYNVNAMEQLERMDFAFESLKKQLFGRLHGVLRKELFGDSEKLEVLQEKSVRKNGAALSSSPESVKIS

SEQ ID NO: 196 - protein, 734 aa, Theobroma cacao
  misc_feature (1)..(734): Tcacao1EG038186t1 WT
MAMPSLSFLHQSPPKPSHVYFCNPSPPPLFLQSPSFVYMTTPLSLHSSKALQIRSSFSSTSTSEPTQDPVRLAFSVNSTLKIAIIGFGNYGQHLAKTLVAQGHSLLAYSRSDHSHIAQELGVSFFLNPSDLCEQHPDVILLCTSIISTEQVLKSLPLKRLKRSTLFVDVLSVKEFAKNLLLDVLPPDFDIICSHPMFGPQSAKQSWENLFFMYEKVRIGNESSRVQRCNDFLAIFEREGCKMVEMSCQEHDKLAAGSQFMTHTVGRVLDMLGLESTPINTKGYETLLELVENTRGDSFDLYYGLFLYNKSALEMLEKLDLGFDELRNELSGRLHDVVKKQLFENAARGKSLQDKSYQNSAGMASILNSLRSQDAIQPYEYKEKISESIDDSSKLKIAIVGFGNFGQFLAKAFVRQGHSVLAYSRTDYCAVAQKLGVSFFSDADDLCEEHPDVILLCTSILSTEKVLNSLPLQRLKRSTLFVDVLSVKEFPRNLFLQNLPSDFDILCTHPMFGPESGKNGWKDLAFVFDKVRVGSDEKRVARCNRVLDVFAREGCRMVEMSCAEHDWHAAGSQFITHTMGRVLEKLKLESTPINTKGYETLLNLVENTAGDSFDLYYGLFMYNVNALEQLEKLDLAFESLKKQLFGRLHGLFQRQLVGNADEKLQVLQNGKGKVFPEKSVVPYGAAMPASPKEKFHVLWENSVLQASPENRLEVVEEKSVRRNGAALATSPESVS

SEQ ID NO: 197 - protein, 690 aa, Glycine max
  misc_feature (1)..(690): Gmax17g13151 WT
MAVSTFQAPPLKPSLPSTLLRRLKRVPLSHSFSLFSAPNTNSFHSSYRALRIRAIDAAQPFDYESRMAQQFHDAQKLKIAIVGFGNFGQFLAQTLVRQGHTILAHSRSDHSLSAQQLGVTFFQNPHDLCEEHPEVILLCSSIISTQRVLLTLPLQRLKRSTLFVDVLSVKEFPKNLLLHALPPDFDVLCTHPMFGPQSAPRAWTGLPFVYEKVRIGAHDDRRIARCEKFLGIFAREGCRMVEMSCADHDKLAAGSQFITHTVGRVLEMLTVKSTPINTKGYESLLNLVENTCGDSFDLFYGLFMYNKNSLEMLERLDFAFEDLRKQLMARLHDVVREHLSDNAGIGKVQSLPDEYVHQLLLKNGQNGSAAAPLLSLPSEDLRSGDVVKLNNYKSNDANQSDDNSKLKIAIVGFGNFGQFLAKTFVRHGHRVLAYSRSDYSLVAQELGVSYFNNIDDLCEQHPEVILLCTSILSTEKVLKSLPVQRLKRSTLFVDVLSVKEFPRNLFLQHLPRNFDILCTHPMFGPESGKNGWNGLAFVFDKVRIGIDESRSSRCDQFLDIFASEGCRMVEMSCAEHDWHAAGSQFITHTTGRFLEKLELEGTPIDTKGYETLLSLVENTAGDSFDLYYGLFLYNRNAMEQLERFDLAFESVKKQLFDRLHGFYRQQVFKHEEKLHDSPERRMLPKISEDK

SEQ ID NO: 198 - protein, 685 aa, Glycine max
  misc_feature (1)..(685): Gmax05g07870 WT
MAVSTFQAAPPKPTLGSSLLSRRMKHVPFSLSFFSAPKTISSYRPILRIRAIDAAQPFDYESRMAQQFHDSQKLKIAIVGFGNFGQFLAQTLVRQGHTVLAHSRSDHSLAAQQLGVTFFPNPHDLCEEHPEVILLCSSIISTQRVLLTLPLQRLKRSTLFVDVLSVKEFPKNLLLHALPSDFDVLCTHPMFGPQSAPRAWTGLPFVYEKVRIGSDEHRIARCEKFLGIFAREGCRMVEMSCADHDKFAAGSQFITHTVGRVLEMLTVESTPINTKGYESLLNLVENTSGDSFDLFYGLFMYNKNSLEMLERLDFAFEDLRKQLMGRLHDVVREQLFDNAGMGKVQSLPDEYVHQLLLKNGQNGSAAPVLSLPSNDLRSSDVVKLYNYKSNDANQSDDKTKLKIAIVGFGNFGQFLAKTFVRHGHQVLAYSRSDYSHVAQELGVSYFNNIDDLCEQHPEVILLCTSILSTEKVLKSLPVQRLKRSTLFVDVLSVKEFPRNLFLHHLPHNFDILCTHPMFGPESGKNGWNGLAFVYDKVRIGIDESRTSRCDQFLDIFASEGCRMVEMSCAEHDWHAAGSQFITHTTGRFLEKLELEGTPIDTKGYETLLSLVENTAGDSFDLYYGLFLYNINAMEQLERFDLAFESVKKELFDRLHGFYRQQVFKHEEKLHDLPERPMLSKISEDK

SEQ ID NO: 199 - protein, 690 aa, Medicago truncatula
  misc_feature (1)..(690): Mtruncatula4g115980 WT
MLGVSTFHSTSLKTPSHSTTTRLNPTFPFSISISPSFNRSTTTKPLTIRAIDAAQSFDYESKIALQFHNSQKLKIAIIGFGNFGQFLATTFVRQGHTVLAHSRSDYSAVAQNIGVKFFPNADDLCEEHPEVILLCTSIISAQQVLLSLPFQRLKRSTLFVDVLSVKEFPKNFFLEILPNYFDIICSHPMFGPESGSSGWKGLPFVYEKVRIGNNETRVSRCEKFLDVFGREGCRMVEMSCADHDRYAAGSQFITHTVGRVLGMLTLESTPINTKGYESLLNLVENTSGDSFDLYYGLFMFNKNSLEMLERLDLAFEDLRKQLIAHLHDVVRNQLFEDAVKVQNLGDDSNHVARKHGQNGSAIVLSSKNQRSADARLHGYYRSNGSGQSDDSTKLKIAIIGFGNFGQFLAKTIVRHGHKVLAYSRTDYSDVARELGVSYFNDADDLCEQHPEVILLCTSILSTEKVLKSLPVQRLRRSTLFVDVLSVKEFPRNLFLQHLPPYFDVLCTHPMFGPESGKNGWKGLPFLFDKVRVGRDESRISRCDLFLDIFSKEGCRMVEMSCAEHDWHAAGSQFITHTTGRFLEKLKLEATPIDTKGYETLLSLVENTGGDSFDLYYGLFLYNINAMEQLQRFDLAFESLKKQLFDRLHGIYRKQVFQNEEKVRDFPERSMLPEKSEDSSVVSFSNTVDAK

SEQ ID NO: 200 - protein, 731 aa, Proteus vulgaris
  misc_feature (1)..(731): Pvulgaris03g178200 WT
MVAVSTFQAPSLPKASTSLSSTIICGNLKLNFLPFSSPKAFSSGVRVHRPLRIRAIDAAQPFDYESRVAQQFHDAQRLKIAIVGFGNYGQFLAQTLVRQGHTVLAHSRSDYTDAARKLGVTFFHNPHDLCEEHPEVILLCSSIISTQRVLLTLPLQSLKRSTLFVDVLSVKEFPKNLLLHALPSDFDILCTHPMFGPQSAPRAWAGLPFVFEKVRIGDDDRRIERCDKFLNIFAREGCRMVEMCCADHDMFAAGSQFITHTVGRVLEMLMLESTPINTKGYESLFNLVENTAGDSFDLYYGLFMFNKNSLEMLERLDFAFEDLRKQLMGRLHGVVRQQLFDNAGIGKGQSLPDDYVYKLLKKAQNGSAPVLSLPSKEHRSDDVAKLDKYNTNDSSQSADNSKLMNALNGFAPVLSRVSKELRFIDVTELNKYKPNISSQSEDSTKLKIAIIGFGNFGQFLAKSIVRQGHKVLAYSRSDYSRVAEEMGASYFNNVDDLFEQHPEVILLCTSILSTEKVLKSLPVQRLKRSTLFVDVLSVKEFPRNLFLQHLSHDFDILCTHPMFGPESGKNGWNGLAFVYDKVRIGTDESRTSRCDRFLDIFSREGCRMVEMSCAEHDWHAAGSQFITHTTGRFLEKLKLEATPIDTKGYETLLSLVENTAGDSFDLYYGLFLYNANAMEQLERFDLAFESLKKRLFDRMHAFYRQQVFEHEEEKLQNLSERRMLPKGSEEK

SEQ ID NO: 201 - protein, 254 aa, Asticcacaulis sp.
MLTKRVEKLGLFGLGAFGRLIVKHLSPYFDIYAYDPSSQARAFARRHNVHMVSLEEAAACRIVVLAVPIRAMKAVAEKIAPLVHPRAMVIDVGSVKMKPAMWLEATLPKSTYILCTHPLFGPQSARKGIHDLEIVVCPVRIRRLDPILRFFRETLDLKVSVATPEQHDKALAAVQGLTHLIAKVMSGLEPLPTVHTTRSYDFLMQGIGLVAADSDELFLSIERDNPFAAEVRRRFFHEIDSLRNRLEAHDGSGN

SEQ ID NO: 202 - protein, 254 aa, Asticcacaulis sp.
MLKKRVDKLGLFGLGAFGRLIVKHLAPYFDIYAYDPSPAARAFARRHNVYMASLEEVAACRIVILAVPIRAMKAMAEKIAPLVHPRALVIDVGSVKMKPAVWLEAALPKSTYILCTHPLFGPQSARKGIHDLEIVVCPVRIRRLNPILRFFRETLDLKVSVATPEQHDKALAAVQGLTHLIAKVMSGLEPLPTVHTTRSYDLLMQGIGLVAGDSDELFLSIERDNPFAAEVRRRFFHEIDGLRNRLEAHDGNGK

SEQ ID NO: 203 - protein, 271 aa, Bosea sp.
MSSKIRTISTIGIMGFGAFGRLMARHLQPHFALRVCDPVNTPAANTSGKGLQPATAAEVAACDLVILAVPVPAIPEAITTLRPHLKAGAIVLDVGSVKIGPARAMQAALPDDIEIIGTHPLFGPQSARDGLAGLKIALCPIRGKSTPRIAAFLRHVLKLKVIVTTADAHDREVAMVQGLTHLIAKILVRMEPLPRTMTTASFDLLMQATEMVRYDAPNVFMAIERANPHAKAVRDRFFALAEEMRLFLEHGHAETAQSASLPHKVAEVAQA

SEQ ID NO: 204 - protein, 270 aa, T. xiamenensis
MPFLFPDHPTIGIFGFGAFGCLTARHLADHFPVLVHDVNPDAVSAYVSEAAHGNIRAADILSVAKCDIVILAVPVTEMRSVIATISPYLRTGAIVLDVGSVKMEPAQAMLEGLPDHVEIIGTHPLFGPQSARDGISGLKIAICPVRGYKFRRIAAFLRHILRLKVFVVTPEVHDREAAVVQGVTHLIAKVLARMDPLPVRMTTASFDLLVKATEMVRYDAPSVFWAIENENPYAGAVREQFFELAMGVRDQLAGDKLAGDKCVVAAGMAK

SEQ ID NO: 205 - protein, 266 aa, Methylobacterium sp.
MSALHLASPAPSVGLVGFGAFGRLIARHLAPHARLTIHDPYLPAGLIAAQAGPVAVAADLRRVAACPVVILATPVARLDEAVQALAPHLRPGTLVVDVGSVKTGPAAILAAGLPADVEILATHPLFGPQSAGDGIRGLKIAVCPIRGRGAFRAAAFLRRGLGLDVILTTPEAHDRAMASVQGLTHLIAKVLVAMEPLPTRMTTRSFDLLMQAVAMVRDDAPDVFHAIERANPHAAQVRQRFFALAGQLDAELAGEAVPAEPVRLAS

SEQ ID NO: 206 - protein, 266 aa, M. extorquens
MSALHPSAPAPSVGLVGFGAFGRLIARHLAPHARLTIHDPYLPAGLIAAQAGPEAVAADLRHVAACPVVILATPVARLGEAVRALAPHLRPGTLVVDVGSVKTEPAAILAAGLPADVEILATHPLFGPQSAGDGIRGLKIAVCPIRGRGAFRAAAFLRRGLGLDVILTTPEAHDRAMASVQGLTHLIAKVLVAMEPLPTRMTTRSFDLLMQAVGMVRDDAPDVFHAIERANPHAAQVRQRFFALAGQLDTELAGVAVPAAPVRLAS

SEQ ID NO: 207 - protein, 256 aa, M. aquaticum
MPFPLDTPVSVGLIGFGAFGRLVAAHLAPHADLRVHDPFVPSGVIAEAGAVPATLAEAAACPVVILATPVSTLAAVVEGMTPHLRPGALVLDVGSVKVRPAEIMRAGLPKDVDIVATHPLFGPQSARDGLRGLKIAVCPVRGERARRVGAFLRRALGLTVILTTPEAHDREAAAVQGLTHLIAKVLVAMEPLPTRMTTRSFDLVMQAVGMVRHDAPEVYHAIERENPFSAEVRRRFFDLAAGMNAELGEGDSRREA

SEQ ID NO: 208 - protein, 242 aa, Brevundimonasnasdae
MRDRLGLIGFGAFGRLTARHLSAGFEILAHDPAASDDEGLATLTDLATAAACPTVVLAVPVEVLEATLIAIGPHLRPDALVIDVGSVKVKPAKAMNALLPPGVRIVGTHPLFGPQSGKDGIAGLRIAVCEVRGAKDARRVAAFCRRALRLKVFQVSPEDHDREAATVQGLTHLIARVLMAMEPLPTRMTTASFDRLMQAVDMVRHDSPAVFRAIERDNPFAAEVRERFFALADEARGGVASN

SEQ ID NO: 209 - protein, 270 aa, S. marina
MGLKQTFERAHSVEQAQQPSVGLVGFGGFGRLIARELAQGNKLTICDPLYSRAVLPDGQRLTLQGLAEVAQSDIVILAVPVSAMAHVCRVLAPHLRPGTLVVDVGSVKVAPMQDMQRLLPAHVEILGTHPLFGPQSARSGIAGHKIALCPVRGSKWRRVAAVLRRRGLQVLVTSAQDHDRELAVVQGLTHMIGKVLSDLGPMPERLTTASFDLLREAVRMVQDDPPTVLHAIEVANPYAAEVRNAFFERAEELKAQFEAHPEVGQTVPAS

SEQ ID NO: 210 - protein, 246 aa, P. zucineum; identical to SEQ ID NO: 140

SEQ ID NO: 211 - protein, 259 aa, Sphingomonas sp.
MAEARVTKVSVIGCGSFGQLVLRSIAPHVDVTCYDADRSTLREIDYPMAMDCASAAAADIVVLAVPVQAIEEVLRAIAPHLRASALVVDVCSVKRKPLAAMARLLPSHCEILGTHPLFGPQSALRGLAGSGIALVPVRGRQWRRVAAFLEKALHLDVIVTTAERHDRDMAYVQGLTHMLARVVGQMRLPTTPLTTRTYDHMLSMVGLVGQDSDALFEAIMAENPYSAAVYDEFVGQFTKLRDLVNGFDIIPLRQKAEQE

SEQ ID NO: 212 - protein, 245 aa, C. hutchinsonii
MRTLGIIGFGGFGQFMVKHLQPYISVTVHDLTDLSHIAAEHKVEWGTLQETASKDIVILAVPVQFLESLLLEIKDYLKAEALIVDVSSVKVKPIELMLKHLPLTVDILGTHPLFGPQSGKNGIKGLNMVVCPVRSKKMRAITHFLRNVIQLNVLERTPETHDKQMAYVQALTHFIGRSINEMDIPDVEQKTPAYQYLLDIKRNLGGDSMDLFLTIELENPYAKKVREEFMGALKSLNDRLEHIKR

SEQ ID NO: 213 - protein, 274 aa, Glycine max; identical to SEQ ID NO: 171

SEQ ID NO: 214 - protein, 271 aa, Unknown; identical to SEQ ID NO: 121
  GmPDH1

SEQ ID NO: 215 - protein, 272 aa, C. cajan
MSTSSSSQTQSLKIGIVGFGTFGQFLAKTMIKQGHTLAATSRSDYSDLCLQMGIHFFRDVSTFLATDLDVIVLCTSILSLSEVVRSMPLASLKRPTLFVDVLSVKEHPKDLLLRVLPEDSDILCTHPMFGPVTGKNGWRDLTFMYDKVRIRDEATCSSFIQIFASEGCKMVEMSCEEHDKAAAKSQFITHTIGRTLGEMDIKSTPIDTKGFEALVKLKETMMGNSFDLYSGLFVHNRFARQELENLEHALYKVKEMLVQRMNEEQGQERLES

SEQ ID NO: 216 - protein, 269 aa, Proteus vulgaris; identical to SEQ ID NO: 173

SEQ ID NO: 217 - protein, 239 aa, Medicago truncatula
MSSSSKSLKIGIVGFGTFGQFLANTMIKQGHTLTATSRTDYSQLCDQMGIHFFRDITAFLDADMDVILLCTSISSLSEVVGSMPLACLKRPTLFVDVLSVKEHPKNLLLKVLPEESDILCTHPMFGPVSGKNGWQNLTFMFDKVRIKDEVTCSKFLQIFASEGCKMVEMSCEEHDKAAAKSQFITHTIGRTLAEMDIKSTPIDTKGFQTLVELKKPVMGCSFDLYSGLFVYNRFARQEV

SEQ ID NO: 218 - protein, 266 aa, Medicago truncatula
MSNSPSLKIGIVGFGSFGQFLAKTMIKQGHTLTATSRTDYSHTCLQLGIQFFRDVGTFIEANNDVILICASIMSFTKVLSSMPLACLKKPTTLFVDVLSVKEHPREVLLRVLPEESDILCTHPMFGPESGKNGWKDLNFMYDKVRIHDEATCSNFLHIFASEGCKMLQMSCEEHDKIAAKSQFITHTIGRTLAEMDIESTPIDTKGFQTLTQLKNTTMRDSFDLYSGLFVHNRFAKQELENLQRALDRVKEMLVQRMREELGPEKD

SEQ ID NO: 219 - protein, 266 aa, Unknown; identical to SEQ ID NO: 124
  MtncADH

SEQ ID NO: 220 - protein, 272 aa, Solanum lycopersicum; identical to SEQ ID NO: 126

SEQ ID NO: 221 - protein, 392 aa, Z. mays
MASSLRHFAGLGCFSAAASSSASTSFLPGYAPDFCVFVALRPIKPPATAVANPPASPSPLEEEHRQQAAVPWHSDDPPAPSVPAPLRVGIVGFGNFGQFIAGGVQRQGHTVLAASRTDYSAYCAQHGIRFFRSVDALCEEQPDVLLICSSILSTESVVRAIPFHKLRPDTIVADVLSVKEFPRNLLLEVLPPGFGIICTHPMFGPESGKHGWGKLPFVFDKVRVADDGDQAATCDRFLSIFEQEGCRMVEMSCAEHDRYAAGSQFITHTIGRVLSQLNLSSTPINTKGYETLLQLTQNTVSDSFDLYYGLFMYNINATEQLDRLEMAFEKVRQMLSGRLHDFIRKQIVERADPSGKLANGRSSSPAAHHLSTLTEENKTRVSPALTLASPTL

SEQ ID NO: 222 - protein, 367 aa, C. variabilis
PPHPASPPAGVRVLALDAAFSFDREAQLRQQHSQQSKLKIGIVGFGTFGQFLARRMVQAGHEVIATSRSPYHDQAAAMGVRYFTDANDFCEEHPEAVILATSILSLEQVLLSLPVQRLKRSTLFVDVLSVKEFPKRLLLRELPPEVDVLCTHPMFGPDSGKGSWAGLNLQYERVRIGCEPDRQRRCDTLLQFFEREGCRMVEMSCEEHDQLAASTQFITHTLQATPIDTKGFQSLLSLVDNTANDSFDLYYGLFMYNQNSTEQLDRLEKAFDEVKARLLHQLHDKVRQQIFHGEMYQAKPQLMLPDRSSGAGSSSDSDGGGAGCSPSWQAQPAAAESGGSVGGNGGGNGGGAQPGSVNPFTMSIESP

SEQ ID NO: 223 - protein, 335 aa, C. subellipsoidea
MKVRALDAPMPFDFEHKATRILAKRKQLTIGIIGFGNFGQFLAERLVQAGHTVLATSRTDYREVAAGMGVAFFTDINDFCEEHPEVVIFASSILSMGSVLGGLPVQRLKRNTLFVDVLSVKEFPKRLMLSTLPSEVDILCTHPMFGPDSGKHSWQGLTLMYERVRVAGSADRQKRAANLLRFFETEGCRMVEMSCEEHDRIAASTQFITHTVGRILGSMHLMPTAIDTRGFQSLLNLVDNTTNDSFDLYYGLFMYNANATEELERLEHAFDSVKKQLFRRLHDVAREQLFQQAPAAAPERLLLKAGRSPQAEAGQNSSNGGSQSQREHAESTPLI

SEQ ID NO: 224 - protein, 403 aa, C. reinhardtii; identical to SEQ ID NO: 127

SEQ ID NO: 225 - protein, 321 aa, O. lucimarinus
MIVRCHGPPASRVFSRLGRIRTARTRTALKGVRALDAAQPFDGENKQRMREHKIKLKIGIIGFGNFGQFLSKHFVDQGHTVIATSRGNYSDIAKDLRVRFYRDADDFCEEHPDVVVVCTSILSTDATLRNFPLQRLKRSTLFCDVLSVKQFPKQLFQQLLPPDFDILCLHPMFGPDSGKHGWRDLPLVFDKVRIGTEPCREERCARLLGIFEAAGCRMVEMSCEEHDRQAASSQFITHTVGRMLGTMELTETTISTKGFESLLSLVDNTYNDSFELYYGLFMYNKNATAELSRLELAFTKVKGELFDRLHERIRNDIFEES

SEQ ID NO: 226 - protein, 363 aa, P. trichocarpa
MLPLISTVPQTLSPSLSFHFHPFPSSSTPSLSLHIPLKNTLRIRSIDAAQPYDYESHLRTQHLKSQSLKIAILGFGNFGQFLSKTLSRQGHTLLAYSRSDYTDIAKNLGVTFYSNPHDLFESHPEVVILCTSILSTEKVLQTLPFQRLKRSTLIVDVLSVKEFAKNILLKYLPVEFDILCTHPMFGPESGKISWVGLPFVYDKVRIGNEEDRITRVERFLDVFAKEGCRMVEMTCAEHDRYAAGSQFVTHTMGRVLERFGLDSSPINTKGYDTLLDLVENTGGDSFELYYGLFMYNKNAMEQLERLDMAFEAIKKELFGKLHHVYRKQLFGNADEGAEERPKVQKLLHNGAPPSDDVVKQETS

SEQ ID NO: 227 - protein, 358 aa, Unknown; identical to SEQ ID NO: 129
  AtADH2

SEQ ID NO: 228 - protein, 430 aa, P. patens
MGALPLTSIAHCATTSSYQQTRYGVVGCKVPALVQIDSVFGFAASELQGDFRKPSQLFLGNGFRVSGRQSQWQRSALDIRAVDAAQPFDYESRKLQELEKSSKLKVGIVGFGNYGQFLAARITSQGHRVLAHSRTDYSEKAQELGVTYFRNADDFCEEHPEVVLLCTSILSTVAVLQSLPLQRLRRNTLFVDVLSVKEFPKNLFLQALPAEFDVLCTHPMFGPESGKGSWAGLPFVYDKVRISNGRRSRIADRFLDIFASEGCRMVKMTCAEHDRYAAGSQFITHTVGRVLGKLGLESTPINTKGYETLLRLVENTEGDSFDLYYGLFMYNPNATEELERLEIAFDSIKRQLFGQLHDVLRKQLFGANVADKARLPHDPSNSSSTNGISKNGGSGIASNSNTALPILESVLGNSNELDKDSDSISKSSKQ

SEQ ID NO: 229 - protein, 385 aa, O. sativa
MAMSCSSSSVRLRLNLAPSRRRTAAPANLQVLRCVGMAASPLRLCATRATGGDARQPFDHVPRGVEEIGEMEEEEEGRRRRRGLKIAVVGFGNYGQFLTRTLVRQGHTVLAHSRSDYSAVAAELGATFFTDPHDLCECHPDVVLLVTSILSAEAVLRSLPVHRLRRDTLFADVLSVKEFPRNLLLGTLPEEFDIICTHPMFGPESARDGWGGFPFVFDKVRVGDCPARHTRAEAFLDIFAREGCRMVEMSCAEHDAHAAETQFLTHTVGRTLAMLELQPTPINTMGYETLLRLVDNTCSDSFDLYNGLFMYNNNSTELLNRLEWAMDSVKKRLFDGLHDVLRRQLFEGSPPLDSVSAAAAAAGSPPDDAPIDGDLDSDNDEEELE

SEQ ID NO: 230 - protein, 362 aa, Sorghum bicolor
MLSSSTSTLRLHQPTRPHRHHPPAPAAGGATHLASPRRWRGHAPGASSPPALRARAQRIRALDAAQPFDFESRAAGLLEERQRLKIAIVGFGNFGQFLARTFARQGHTLLAHSRTDHSALASTLGASFFTDPHDLCECHPDVVLLATSILSAEAVLRSLPVHRLRRNTLFVDVLSVKEFPRNLLLSSLPPDFDVICTHPMFGPESARDGWDGLPFVFDKVRVGDCPARRARAEAFLNIFEREGCRMVEMSCAEHDAHAAETQFLTHTVGRMLAMLELRSTPINTKGYETLLRLVDNTCSDSFDLYNGLFMYNKNSTELLNRVEWAMDSVKKKLFDGLHDVLRKQLFEGSPHAPNVSSSNVRK

SEQ ID NO: 231 - protein, 387 aa, M. acuminata
MYAAIISAKAKQAREGETDRIRRWSHAAFSFFLTFRTRKMLLSRVLPSNTTLLPASSHARAAPLRYRHVPAGGGAITVPVRRSFAMTIRARDSAPVLDVEPQPLKLLDRRTKLKIAVIGFGNFGQFLARTFAAQGHEILAYSRTDYSDTARSLGVAFFDDQNDLCEQQPDVVLLSTSILSAEAVLRSLPIQRLRRSTLFVDVLSVKEFPKNLFLQLLPPDFDILCTHPMFGPDSGKHGWAGLPFAYDKVRIGDSDDRVERCRAFLEIFDREGCRMVEMSCAEHDETAAEIQFLTHTIGRVLAKLDLKSTPINTKGYETLLNLVQNTCSDSYELYNGLFIYNKNSTELIEKLNGALDTTKKELFERLHGIFRKQLFEGSARKFAGGDN

SEQ ID NO: 232 - protein, 264 aa, J. curcas
MLEMSCQDQDKYAAGSQFITHTVGRVLKMLKLESTPINTKGYESLLDLVENTAGDSFDLYYGLFMYNKNALEMLERLDLAFESLKKEMSGKNGWKNLAFVFDSVRLGSDVTRVARCNQFLDIFGREGCRMVEMSCAEHDWHAAGSQFITHTMGRVLEKLGLGSAPINTKGYETLLNLVENTVGDSFDLYYGLFMYNANAMEQLERLDLAFESLKKQLFGQLHGVLRKQLFENSEKSQVLTVEALASELPQNDAAPASSLEILNI

SEQ ID NO: 233 - protein, 317 aa, G. soja
RPPAVYPRLLHCPRLHCHYVNVSLFSSLSNGTSSSSCRSLRILRAIDRESEVPAQQLHHVQNQKLKIGIIGFGKFGQFLARTLVRQGHTVLAHSRSDYTHVALELGVTFFEKPHDVCDELRQGHTVLAHSRSDYTHVALELGVTFFENPHDVCDERPDCTHPMFGPQSAKDGWSGFLFVFDKVRIGTDEARTSRCDWCLNIFSSEGCQLVETPCAEHDRQAAGSQFITPTVGRILEKLDFLEPTKIDTIGFESLLNLMDNTVRDSFDLYFGLFLFNKNSRQQLERFHLAFESLQNQLFDHVLDNLKQVLKLEEESHD

SEQ ID NO: 234 - protein, 273 aa, S. thermophila
MRSREIEIPGIVKGVQTFYDAPMRVGVYGLGRFGRFWAETLGTRFEVYGYSRTPKTIAPRHFTLTTYEGLLSCDVIVLCVSISAVEEVARSLARDLPPSTLVMDTCSVKTYPLEVLSRTLPDGIDILGTHPMFGPDSARDGIAGLPIVLTPCRVTEEQSSFWEETFREMGLSVHRMTAEEHDREAAYTQGITHFVGRVLGELHLEDSPIATVGYRKLLEIREQTCNDPWQLFLDLQHYNPYTRRMREDLARAFTRILAVLDRTLDGGADPSVR

SEQ ID NO: 235 - protein, 254 aa, S. pacifica
MKIAVYGLGRFGRFWAELLMDIGFTVCGYNRSSRDSGNRIPRVGLEEACASDVLFICTSISSIPQVAEEIAPLLRPDTLVVDTCSVKLYPLQELSRALPESQPILGTHPMFGPDSAGEGISGLPLVISPWTADENVLTFWTEKFSRAGLDVISMSADEHDHEAARTQGITHFIGRFLASLELKPSRISTLGFRKIFEVMEQTCNDPWQLFIDLQKYNPYTGEIRGEMTRHFEQMIQLLDSQQIDSQPIDSQQKQ

SEQ ID NO: 236 - protein, 263 aa, S. africana; identical to SEQ ID NO: 135

SEQ ID NO: 237 - protein, 271 aa, S. coccoides
MGENTWKGSVAVLAYFLYSEGMKIGVYGMGRFGSFWASLLASHGHEVYGYTRHAVSVPPGVSLVGEDEILGQENLFLCVPISAFKDVVTNISPRLTPATTVFDTCSVKLYPYAVMEELLVSRGIPCIATHPMFGPDSGAHGVKDLPMMLSSVASSADIGPWEKEFSSWGLTVLHMNCDTHDKETAWSQGVTHFVGRTLDELHLGHTDLATTGYRRLMSIVEQTCNDPRQLFYDLQRYNPYASDMRRHLRQALDKVMAELVAQDMAVRMEKT

SEQ ID NO: 238 - protein, 242 aa, Bacteriovorax sp.
MKVGIIGFGRLGSLISKYMSQDFTLLVHDLHDYSSEIEKIGATPATFEEACDCPIVIPFVPMSEFENCIKKMAPLLKKETLLVDVCSVKEMPVDIMMKHLSKDIQILATHPMFGPDSAKDTLFGTKIAVCPVRIDQELYNKISTYLRSHGIKTIESTPEEHDKQIANTLVLTHLIGRSLIDFDAHRLEIDTKGYRRLLKILETVENDSWQLFEDMNKYNRHAKETRETFLHSLKGVISRLEN

SEQ ID NO: 239 - protein, 341 aa, C. moran
MKSKKKICIVGLGRFGTLIASILKKDFEVSVMVSDAKKYFEKAEKLGIKIIDKEDLKIFDIVILCPPISKTEQIIKEIGPFLKEKSLLVDTCSVKTLPCQWMKKHAPKNVEILGTHPMFGPVTTKFNLEKQTWKLDGLQIVLCPLRINQKKLEKIRKFLKKLKLKVIETTPQEHDRQNAKTLALVHFLGRALVTSGVKEQEIFTPGYADLLKIIPHTASDNWQLFFDMNNFNPFSEKIRKDFLRSCHNLDFKIAFSKGKDDLESSRNIIDSVDEKVFELLKIRFGEVRKIGKTKKKIGKNVRDTKREERIIENKVRKFKMDKELVENIYKAIFNHSYKIQK

SEQ ID NO: 240 - protein, 243 aa, D. proteobacterium
MIGTIGFGRFGRLMAGYLARDCKVKVFNRSDKTKEIIGIGAEPATLEEVCRQKVVILSVPISHMQETLERIASLLRPDTMVIDVCSVKVYPVAWMKELLPPSVPLLGTHPMFGPDSAAEALLDRKIVLSRVRIDDERYQKVKKYLLGKGLNVIEATPEEHDRQIAVSLALTHFIGRGLDEFGAKDLIIDTEGYKRLLHILGVVNHDTWQLFKDMYQYNPYARENRLAFMAALKRLEEKLENGT

SEQ ID NO: 241 - protein, 248 aa, D. multivorans
MIGIIGFGRFGRLMAGYLAKDYTVYVYNRSDKAEQISEIGAVPADMAQAAGQRVVILSVPISRMADFLKEIAPLVVPDAVVVDVCSVKVYPVQWMTTLLPPSVDILATHPMFGPDSAATSLLDRKIVLCKTRISDARYDKIKSYLKARGLVVIETTPEEHDRQIAMSLCLTHFIGRSLEASGTGELIIDTEGYKRLLHILEVVTHDTWQLFVDMNRYNPYAEKSRRAFMDAMKTIEERLKKDRLKTEG

SEQ ID NO: 242 - protein, 240 aa, Parcubacteriagroup
MTIGIIGFGRFGKFYSDIWKQFGSVIVYSHRDVSKDCAEMGIAQGTLKNVCLADIVIIACAISDFEKTVKEIRNFLRHGTIVMDVCSVKIMPCVAMKKYFPKKIELLGTHPMFGPDSAKNGLIGLKMVLCPVRISDENLSFIKNYFKKLHLEIIETTSKIHDKESARSLCMVHFLGRGLEKLNIKKMPISTMGYERVLQVSENVTNDSMELFRDMQKYNPYAKVERERLLKALNRINKNF

SEQ ID NO: 243 - protein, 435 aa, Methanohalophilus sp.
MKILIIGGTGEMGQWFATFFKKRGYEVWISGRSGKVEVAERLGVHFTAEPEIVIPICDIVIISVPINITPTIIAQTAPKMKKGSLLMDLTSLKKKPVEAMKKYVPENVEFLGTHPMFGPSIPSLQGQTFILTPVEGRCDQWFDHIFNLLSEEEANIEIITPDEHDHFVSIVQGLTHFAYITIGATMQTLDFDVKGSRRFMSPVYDIMLDFVGRILGQNPELYALIQMENPEVIHVHDVFIDQCRHFSSMVRSHDTGQFCEEMKAAALHFGDTASALRRSDKLINSKVAEFEELVHSTGQERGLLHIYSRNIHVGIIKKVTSHNVTLKEGKRELQLKIGNIRTLSADELNHWKENKLKPTLRDISVFIPRSARPFTIQQILDCHIDGVKVETIDTYLHKMGPSATFRLNIRGDLDACEIQRDMEELLEGMGCSLRN

SEQ ID NO: 244 - protein, 435 aa, M. mahii
MKILIIGGTGEMGQWFANFFKKRGYEVWLSGRGGKSEVAERLGVHFTAEPDIVIPTCDIVIISVPINITPTIIAQTAPKMKKGSLLMDLTSLKKKPVEAMKKYVPENVEFLGTHPMFGPSIPSLQGQTFILTPVEGRCDQWFDHIFNLLSEEEASIEVITPDEHDHFVSIVQGLTHFAYITIGATMQKLDFDVKGSRRFMSPVYDIMLDFVGRILGQNPELYALIQMENPEVIRVHDIFIEQCRHFSSMVRSHDTGQFCEEMKAAALHFGDTASALRRSDKLINSKVAEFEELVHSTGHEKGLLHIYSRKTHVGIVKRVTSNNVTLKEGKKELQLKIGNIRILSADELNHWKENKLKPILRDISVFVPQSAKPFTIQQILDCRIEGVKVETIDTYLHKKGPTATFRLKIRGDLDAAEIHREMEELLEGMGCTLRK

SEQ ID NO: 245 - protein, 438 aa, M. psychrophilus
MKVLIIGGTGEMGQWFTRFFKNNGYEVTVWGSGGKLEIARKMGVDFAPDLDIAISESDIVIVTVPIDITEQVIQETAPKMKSGSLLMDLTSLKVKPTEVMKEYAPLDVEILGTHPMFGPSIPSLHGQIFILTPIEGRCRKWFPVIRALLEDNGAHIEIISAQEHDRIVSVVQGLTHFAYITIGTTFNRLDFSVAQSRRFMSPVYDIMVDFVGRILGQNPYLYAFIQMENPEVLKVHETFMQECREMSAIVREHDVESFISRMKDASAHLGDTAAALRRSDKLINFKIAELDELVNSIGMEKGLRHIYSNVIHVGTVKKVSPRNVILSTGTKLVSLKLENIRLLSPEELREWKTKNLRGHSRDISVIIPKGADPEVIRSIISNNMNVISVRLIDTYTCAKSDTGSSVTYRVGIIGDANATVTSNEIAALLTGIGCKLRG

SEQ ID NO: 246 - protein, 443 aa, M. evestigatum
MNNSILIIGGTGEMGQWFAKFFKREGFEVTLWGSSQRVDIADKLGVNFASDLDNAIEKSDIVIVSVPIDITEKVISETAPKMKPGSLLMDFTSIKTKPVEAMEKYAPENVEILGTHPMFGPSIPSLYGQIVIMTPISGRCDNWFPVVKSVFENNGAHIEVIDPKEHDKFVSVVQGLTHFAYITIGSTFKRLDFDVSESRKFMSPVYDIMIDFVGRIIGQNPYLYALIQMENPEVLKVHDAFKKECNNISEIVRQQDVESFVENMKSAASHFGDTTSALHRSDKLINSKLQEFDQIAKLVGKECGLVHRYSGATHVGYVEKVKPRHVVLSKPYQKNKSISLKIENVRLLSENELRQWKINNLKHITRDISVFIPTNAVPETIRDVISNNANVVDTEIIDIYSGFENIENLSATYRITVLEDSNPNLIQDEVKKLLEGLGCYPRS

SEQ ID NO: 247 - protein, 310 aa, Methanosaeta harundinacea; identical to SEQ ID NO: 147

We claim:

1. An engineered arogenate dehydrogenase polypeptide comprising at least 95% sequence identity to any one of the polypeptides of SEQ ID NOs: 10-55 having a non-acidic amino acid at a position corresponding to residue 220 of SEQ ID NO:10, SEQ ID NOs:124-143 having a non-acidic amino acid at a position corresponding to residue 220 of SEQ ID NO:10, SEQ ID NOs:149-151 having a non-acidic amino acid at a position corresponding to residue 220 of SEQ ID NO:10, SEQ ID NOs:201-212 having a non-acidic amino acid at a position corresponding to residue 220 of SEQ ID NO:10, or SEQ ID NOs:218-242 having a non-acidic amino acid at a position corresponding to residue 220 of SEQ ID NO:10, wherein the engineered mutant arogenate dehydrogenase polypeptide has increased prephenate dehydrogenase activity as compared to an identical sequence with a D or E amino acid at a position corresponding to amino acid residue 220 of SEQ ID NO: 10.

2. The engineered polypeptide of claim 1, wherein the non-acidic amino acid residue is an asparagine (N) amino acid residue or a cysteine (C) amino acid residue.

3. The engineered polypeptide of claim 1, wherein the polypeptide has greater prephenate dehydrogenase activity than arogenate dehydrogenase activity.

4. The engineered polypeptide of claim 1, wherein the engineered polypeptide is selected from the group consisting of SEQ ID NO: 10 (MtncADH D220C), SEQ ID NO: 11 (MtncADH D220N), SEQ ID NO: 12 (AtADH2 D241N), SEQ ID NO: 13 (AtADH2 D241C), a polypeptide having at least 95% sequence identity to SEQ ID NO: 10 and comprising a cysteine (C) amino acid residue at position 220 of SEQ ID NO: 10, a polypeptide having at least 95% sequence identity to SEQ ID NO: 11 and comprising an asparagine (N) amino acid residue at position 220 of SEQ ID NO: 11, a polypeptide having at least 95% sequence identity to SEQ ID NO: 12 and comprising an asparagine (N) amino acid residue at position 241 of SEQ ID NO: 12, and a polypeptide having at least 95% sequence identity to SEQ ID NO: 13 and comprising a cysteine (C) amino acid residue at position 241 of SEQ ID NO: 13.

5. A polynucleotide encoding the engineered polypeptide of claim 1.

6. A cell comprising the engineered polypeptide of claim 1.

7. The cell of claim 6, wherein the cell is a plant cell.

8. A method for increasing production of at least one product of the tyrosine or HPP pathways in a cell comprising introducing the engineered polypeptide of claim 1 into the cell.

9. The method of claim 8, wherein the cell is a plant cell.

10. The engineered polypeptide of claim 1, wherein the polypeptide has a sequence at least 95% identical to any one of SEQ ID NOs: 10-55 having a non-acidic amino acid at a position corresponding to residue 220 of SEQ ID NO:10, SEQ ID NOs:124-143 having a non-acidic amino acid at a position corresponding to residue 220 of SEQ ID NO:10, or SEQ ID NOs:149-151 having a non-acidic amino acid at a position corresponding to residue 220 of SEQ ID NO:10.

11. The engineered polypeptide of claim 1, wherein the polypeptide has a sequence at least 95% identical to any one of SEQ ID NOs: 10-55 having a non-acidic amino acid at a position corresponding to residue 220 of SEQ ID NO:10.

* * * * *